(12) United States Patent
Desjarlais et al.

(10) Patent No.: US 10,982,006 B2
(45) Date of Patent: Apr. 20, 2021

(54) HETERODIMERIC ANTIBODIES THAT BIND FIBROBLAST ACTIVATION PROTEIN

(71) Applicant: Xencor, Inc., Monrovia, CA (US)

(72) Inventors: John Desjarlais, Pasadena, CA (US); Alex Nisthal, Monrovia, CA (US); Seung Chu, Upland, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 16/375,777

(22) Filed: Apr. 4, 2019

(65) Prior Publication Data

US 2020/0165356 A1 May 28, 2020

Related U.S. Application Data

(60) Provisional application No. 62/652,835, filed on Apr. 4, 2018.

(51) Int. Cl.
*C07K 16/40* (2006.01)
*C07K 16/28* (2006.01)
*C07K 16/46* (2006.01)

(52) U.S. Cl.
CPC .......... *C07K 16/40* (2013.01); *C07K 16/2809* (2013.01); *C07K 16/468* (2013.01); *C07K 2317/21* (2013.01); *C07K 2317/31* (2013.01); *C07K 2317/565* (2013.01); *C07K 2317/622* (2013.01); *C07K 2317/66* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

(Continued)

*Primary Examiner* — Marianne P Allen
(74) *Attorney, Agent, or Firm* — Louis-Vu T. Nguyen; Robin M. Silva; Morgan, Lewis & Bockius, LLP

(57) ABSTRACT

The present invention relates to novel antigen binding domains and heterodimeric antibodies that bind Fibroblast Activation Protein (FAP).

23 Claims, 294 Drawing Sheets

Specification includes a Sequence Listing.

(56) References Cited

U.S. PATENT DOCUMENTS

| | | |
|---|---|---|
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 * | 9/2002 | Park .............. C07K 16/40 530/387.1 |
| 6,506,883 B2 | 1/2003 | Mateo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |

(56) References Cited

U.S. PATENT DOCUMENTS

| | | |
|---|---|---|
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A2 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2017/0320947 A1 | 11/2017 | Moore et al. |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2019/0263909 A1 | 8/2019 | Bernett et al. |
| 2019/0270816 A1 | 9/2019 | Bernett et al. |
| 2019/0382495 A1 | 12/2019 | Bernett et al. |
| 2019/0389954 A1 | 12/2019 | Bernett et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011133886 | 10/2011 |
| WO | WO2011143545 | 11/2011 |

(56) References Cited

FOREIGN PATENT DOCUMENTS

| | | |
|---|---|---|
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2018041838 | 3/2018 |
| WO | WO2019050521 | 3/2019 |

OTHER PUBLICATIONS

Abbott Laboratories, Strategies and Current Approaches for Improving Drug-Like-Properties During Biologics Drug Candidate Selection, AAPS Webinar—Nov. 10, 2011.

Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.

Alberola-IIa et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., Preparation, properties, and applications of carbohydrate conjugates of proteins and lipids, 1981, CRC Crit. Rev. Biochem., pp. 259-306.

Arnett, et al., Crystal structure of a human CD3-$\epsilon/\sigma$ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Bargou et al., Tumor Regression in Cancer Patients by Very Low Doses of a T Cell-Engaging Antibody, Science, 2008, vol. 321, pp. 974-977.

Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optimizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

(56) References Cited

OTHER PUBLICATIONS

Brandi, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann, et al., presentation slideshow—"Roche Penzberg & Roche Glycart, Schlieren: Centers of Excellence for Recombinant Proteins".

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.

Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.

Chames et al., Bispecific antibodies for cancer therapy—The light at the end of the tunnel?, mAbs, 2009, vol. 1, Issue 6, pp. 1-9.

Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.

Chari et al., Immunoconjugates containing novel maytansinoids: promising anticancer drugs, 1992, Cancer Research 52: 127-131.

Chatal, 1989, Monoclonal Antibodies in Immunoscintigraphy, CRC Press (Book Abstract).

Chelius, et al., Structural and functional characterization of the trifunctional antibody catumaxomab, mAbs, 2010, vol. 2, Issue 3, pp. 309-319.

Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol., 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

d'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization of Therapeutic Proteins by T-Cell Epitope Modification, 2005, Dev. in Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep.-Oct.;3(5):487-94, Landes Bioscience, Sep. 1, 2011.

DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina, Development of potent monoclonal antibody auristatin conjugates for cancer therapy, 2003, Nat Biotechnol 21(7):778-784.

(56) References Cited

OTHER PUBLICATIONS

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the α- and ß-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cß FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$—Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-81376-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H$3) which exhibits rapid, high-level targeting of xenografts, 1996, Cancer Res. 56:3055-3061.

(56) References Cited

OTHER PUBLICATIONS

Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jager, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.

(56) References Cited

OTHER PUBLICATIONS

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No, 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins $o^I_1$ effectively suppress growth and dissemination of liver metastases in a syngeneic model of murine neuroblastoma, 1998, Cancer Res. 58:2928.

Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Natl. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

(56) References Cited

OTHER PUBLICATIONS

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

Muramatsu et al., Production and characterization of an active single-chain variable fragment antibody recognizing CD25., Cancer Lett. Jul. 28, 2005;225(2):225-36. Epub Jan. 23, 2005.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

Neville et al., Enhancement of immunotoxin efficacy by acid-cleavable cross-ling agents utilizing diphtheria toxin and toxin mutants, 1989, Biol. Chem. 264:14653-14661.

Nielsen, et al., Human T cells resistant to complement lysis by bivalent antibody can be efficiently lysed by dimers of monovalent antibody, Blood, 2002, vol. 100, No. 12, pp. 4067-4073.

Nisonoff, et al., Letters to the Editors: Recombination of a Mixture of Univalent Antibody Fragments of Different Specificity, Arch. Biochem. Biophys., 1961, pp. 460-462.

Nisonoff, et al., Quantitative Estimation of the Hybridization of Rabbit Antibodies, Nature, 1962, vol. 194, No. 4826, pp. 355-359.

North, et al., A New Clustering of Antibody CDR Loop Conformations, J. Mol. Biol., 2011, vol. 406, pp. 228-256, doi:10.1016/j.jmb.2010.10.030.

O'Connor et al., Humanization of an antibody against human protein C and calcium-dependence involving framework residues, 1998, Protein Eng 11:321-8.

Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.

Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.

Page et al., 1993, Intermantional. Journal of Oncology 3:473-476.

Panke, et al., Quantification of cell surface proteins with bispecific antibodies, Protein Engineering, Design & Selection, 2013, vol. 26, No. 10, pp. 645-654.

Pessano, et al., The T3/T cell receptor complex: antigenic distinction between the two 20-kd T3 (T3-σand T3-ε) subunits, The EMBO Journal, 1985, vol. 4, No. 2, pp. 337-344.

Pettit et al., Antineoplastic agents 365. Dolastatin 10 SAR probes, 1998, Anti-Cancer Drug Design 13:243-277.

Pettit et al., Dolastatins 24. Synthesis of (-)-dolastatin 10.1 X-ray molecular structure of N,N-dimethylvalyl-valyl-dolaisoleuine tert-butyl ester, 1996, J. Chem. Soc. Perkin Trans. 1 5:859-863.

Pettit et al., Specific activities of dolastatin 10 and peptide derivatives against Cryptococcus neoformans, 1998, Antimicrob. Agents Chemother. 42(11):2961-2965.

Pettit et al., Structure-activity studies with chiral isomers and with segments of the antimitotic marine peptide dolastation 10, 1989, J. Am. Chem. Soc. 111:5463-5465.

Pettit, et al., The dolastatins; 18: Sterospecific synthesis of dolaproine1, 1996, Synthesis 719-725.

Pichler et al., Differences of T-Cell Activation by the Anti-CD3 Antibodies Leu4 and BMA030, Mar. 30, 1987.

Potapov et al., Protein-Protein Recognition: Juxtaposition of Domain and Interface Cores in Immunoglobulins and Other Sandwich-like Proteins, J. Mol. Biol., 2004, vol. 342, pp. 665-679.

Presta et al., Humanization of an anti-vascular endothelial growth factor monoclonal antibody for the therapy of solid tumors and other disorders, 1997, Cancer Res.57(20):4593-9.

Queen et al., A humanized antibody that binds to the interleukin 2 receptor, 1989, Proc Natl Acad Sci, USA 86:10029-33.

Rader et al., A phage display approach for rapid antibody humanization: designed combinatorial V gene libraries, 1998, Proc. Natl. Acad. Sci. USA 95: 8910-8915.

Raghavan et al., Fc receptors and their interactios with immunoglobulins, 1996, Annu Rev Cell Dev Biol 12:181-220.

Rattel, et al., AACR Poster, "Validation of Cynomolgus Monkeys as Relevant Species for Safety Assessment of a Novel Human BiTE Antibody Platform for Cancer Therapy," 2010.

(56) References Cited

OTHER PUBLICATIONS

Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmuller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Rothlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/ß T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

(56) References Cited

OTHER PUBLICATIONS

Spiess, et al., Bispecific antibodies with natural architecture produced by co-culture of bacteria expressing two distinct half-antibodies, Nature Biotechnology, 2013, doi:10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
van Boxel, et al., Some lessons from the systematic production and structural analysis of soluble αβ T-cell receptors, Journal of Immunological Methods, 2009, vol. 350, pp. 14-21.
van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.

(56) References Cited

OTHER PUBLICATIONS

Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zalevsky et al. "Enhanced antibody half-life improves in vivo activity." Nature Biotechnology, vol. 28, No, 2, Feb. 1, 2010, pp. 157-159.

Zamyatnin AA., Amino acid, peptide, and protein volume in solution., *Annu Rev Biophys Bioeng*. 1984;13:145-65.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zeibig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Zheng et al: "IL-2 receptor-targeted cytolytic IL-2/Fc fusion protein treatment blocks diabetogenic autoimmunity in nonobese diabetic mice", The Journal of Immunology, the American Association of Immunologists, US, vol. 163, No. 7, Oct. 1, 1999 (Oct. 1, 1999), pp. 4041-4048, XP002230805.

Kunzendorf et al: "Suppression of cell-mediated and humoral immune responses by an interleukin-2-immunoglobulin fusion protein in mice", Journal of Clinical Investigation, vol. 97, No. 5, Mar. 1, 1996 (Mar. 1, 1996), pp. 1204-1210, XP055521333.

Vie et al: "Human fusion proteins between interleukin 2 and IgM heavy chain are cytotoxic for cells expressing the interleukin 2 receptor", Proceedings of the National Academy of Sciences of the United States of America, vol. 89, No. 23, Jan. 1, 1992 (Jan. 1, 1992), pp. 11337-11341, XP002315803.

Zhang et al., The development of bispecific antibodies and their applications in tumor immune escape., Experimental Hematology & Oncology20176:12.

Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.

Fos et al., ICOS ligation recruits the p50alpha PI3K regulatory subunit to the immunological synapse., J Immunol. Aug. 1, 2008;181(3):1969-77.

Sanmamed et al., Agonists of Co-stimulation in Cancer Immunotherapy Directed Against CD137, OX40, GITR, CD27, CD28, and ICOS.,

(56) References Cited

OTHER PUBLICATIONS

Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al; "High Resolution Mapping of the Binding Site on Human IgG 1 for FcγRI, FcγRII, FcγRIII, and FcRn and Design of IgG1 Variants with Improved Binding to the FcγR", The Journal of Biological Chemistry, 2001, 276(2):6591-6604.
Szymkowski et al; "Anti-CD38—anti-CD3 bispecific antibody in multiple myeloma", Xencor, pp. 1-15.
Julg, B. et al "Enhanced Anti-HIV Functional Activity Associated with Gag-Specific CD8 T-Cell Responses." Journal of Virology 84.11 (2010): 5540-5549. Web. Jul. 13, 2020.
Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1) 60-69.

\* cited by examiner

Bottle Opener or
1+1 Fab-scFv-Fc

Dual scFv

One-arm central-scFv

One-arm scFv-mAb scFv-mAb

Central scFv or
2+1 Fab2-scFv-Fc

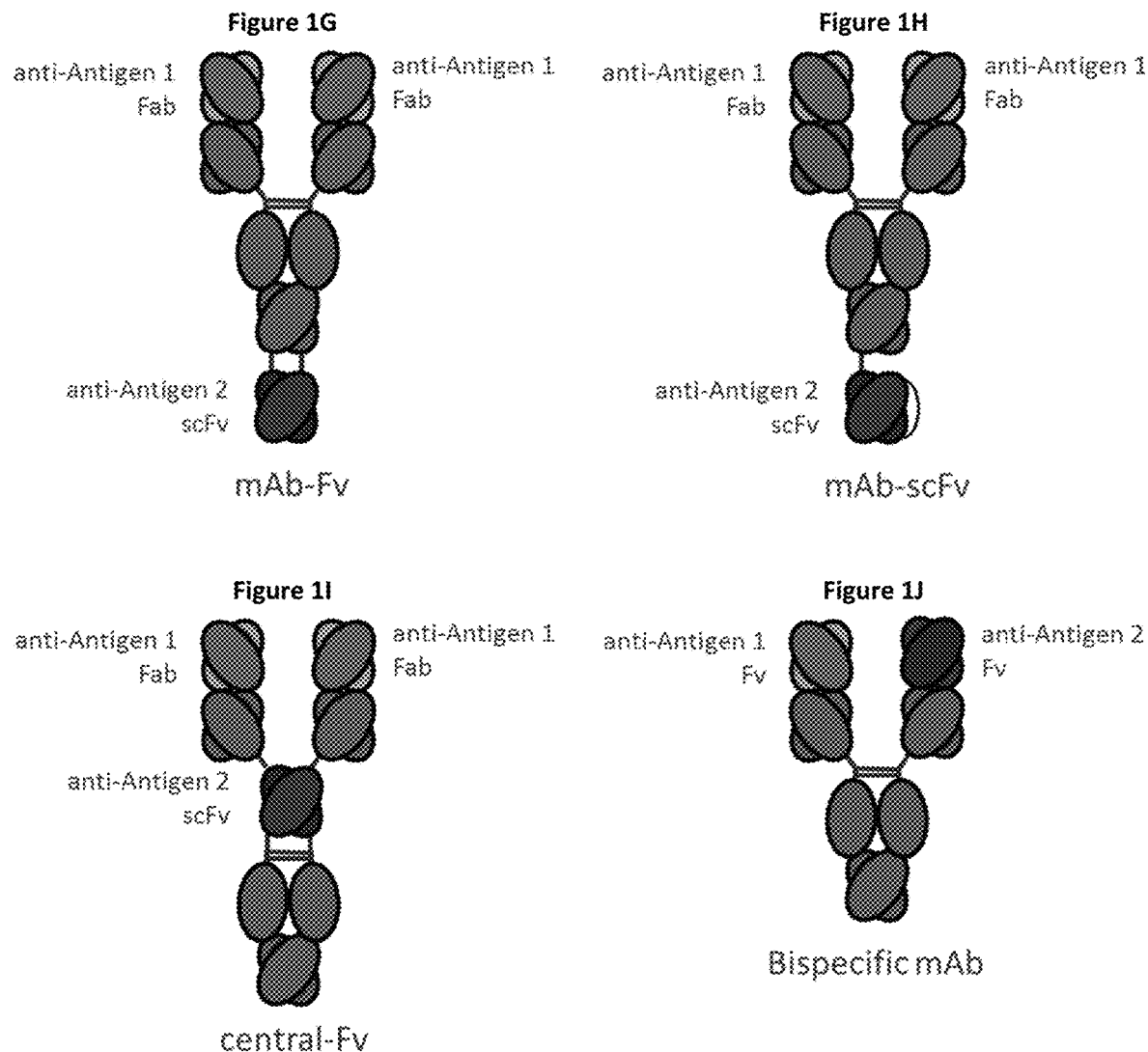

Trident

Figure 2

A) >sp|Q12884|SEPR_HUMAN Prolyl endopeptidase FAP OS=Homo sapiens GN=FAP PE=1 SV=5 (SEQ ID NO: 1)

MKTWVKIVFGVATSAVLALLVMCIVLRPSRVHNSEENTMRALTLKDILNGTFSYKTFFPNWISGQEYLHQSADNNIV
LYNIETGQSYTILSNRTMKSVNASNYGLSPDRQFVYLESDYSKLWRYSYTATYYIYDLSNGEFVRGNELPRPIQYLC
WSPVGSKLAYVYQNNIYLKQRPGDPPFQITFNGRENKIFNGIPDWVYEEEMLATKYALWWSPNGKFLAYAEFNDTDI
PVIAYSYYGDEQYPRTINIPYPKAGAKNPVVRIFIIDTTYPAYVGPQEVPVPAMIASSDYYFSWLTWVTDERVCLQW
LKRVQNVSVLSICDFREDWQTWDCPKTQEHIEESRTGWAGGFFVSTPVFSYDAISYYKIFSDKDGYKHIHYIKDTVE
NAIQITSGKWEAINIFRVTQDSLFYSSNEFEEYPGRRNIYRISIGSYPPSKKCVTCHLRKERCQYYTASFSDYAKYY
ALVCYGPGIPISTLHDGRTDQEIKILEENKELENALKNIQLPKEEIKKLEVDEITLWYKMILPPQFDRSKKYPLLIQ
VYGGPCSQSVRSVFAVNWISYLASKEGMVIALVDGRGTAFQGDKLLYAVYRKLGVYEVEDQITAVRKFIEMGFIDEK
RIAIWGWSYGGYVSSLALASGTGLFKCGIAVAPVSSWEYYASVYTERFMGLPTKDDNLEHYKNSTVMARAEYFRNVD
YLLIHGTADDNVHFQNSAQIAKALVNAQVDFQAMWYSDQNHGLSGLSTNHLYTHMTHFLKQCFSLSD

B) >sp|P97321|SEPR_MOUSE Prolyl endopeptidase FAP OS=Mus musculus GN=Fap PE=1 SV=1 (SEQ ID NO: 2)

MKTWLKTVFGVTTLAALALVVICIVLRPSRVYKPEGNTKRALTLKDILNGTFSYKTYFPNWISEQEYLHQSEDDNIV
FYNIETRESYIILSNSTMKSVNATDYGLSPDRQFVYLESDYSKLWRYSYTATYYIYDLQNGEFVRGYELPRPIQYLC
WSPVGSKLAYVYQNNIYLKQRPGDPPFQITYTGRENRIFNGIPDWVYEEEMLATKYALWWSPDGKFLAYVEFNDSDI
PIIAYSYYGDGQYPRTINIPYPKAGAKNPVVRVFIVDTTYPHHVGPMEVPVPEMIASSDYYFSWLTWVSSERVCLQW
LKRVQNVSVLSICDFREDWHAWECPKNQEHVEESRTGWAGGFFVSTPAFSQDATSYYKIFSDKDGYKHIHYIKDTVE
NAIQITSGKWEAIYIFRVTQDSLFYSSNEFEGYPGRRNIYRISIGNSPPSKKCVTCHLRKERCQYYTASFSYKAKYY
ALVCYGPGLPISTLHDGRTDQEIQVLEENKELENSLRNIQLPKVEIKKLKDGGLTFWYKMILPPQFDRSKKYPLLIQ
VYGGPCSQSVKSVFAVNWITYLASKEGIVIALVDGRGTAFQGDKFLHAVYRKLGVYEVEDQLTAVRKFIEMGFIDEE
RIAIWGWSYGGYVSSLALASGTGLFKCGIAVAPVSSWEYYASIYSERFMGLPTKDDNLEHYKNSTVMARAEYFRNVD
YLLIHGTADDNVHFQNSAQIAKALVNAQVDFQAMWYSDQNHGISSGRSQNHLYTHMTHFLKQCFSLSD

C) >XP_005573377.1 PREDICTED: prolyl endopeptidase FAP isoform X1 [Macaca fascicularis] (SEQ ID NO: 3)

MKTWVKIVFGVATSAVLALLVMCIVLRPPRVHNSEENTMRALTLKDILNGTFSYKTFFPNWISGQEYLHQSADNNIV
LYNIETGQSYTILSNRTMKSVNASNYGLSPDRQFVYLESDYSKLWRYSYTATYYIYDLSNGEFVRGNELPRPIQYLC
WSPVGSKLAYVYQNNIYLKQRPGDPPFQITFNGRENKIFNGIPDWVYEEEMLATKYALWWSPNGKFLAYAEFNDTDI
PVIAYSYYGDEQYPRTINIPYPKAGAKNPFVRIFIIDTTYPAYVGPQEVPVPAMIASSDYYFSWLTWVTDERVCLQW
LKRVQNVSVLSICDFREDWQTWDCPKTQEHIEESRTGWAGGFFVSTPVFSYDAISYYKIFSDKDGYKHIHYIKDTVE
NAIQITSGKWEAINIFRVTQDSLFYSSNEFEDYPGRRNIYRISIGSYPPSKKCVTCHLRKERCQYYTASFSDYAKYY
ALVCYGPGIPISTLHDGRTDQEIKILEENKELENALKNIQLPKEEIKKLEVDEITLWYKMILPPQFDRSKKYPLLIQ
VYGGPCSQSVRSVFAVNWISYLASKEGMVIALVDGRGTAFQGDKLLYAVYRKLGVYEVEDQITAVRKFIEMGFIDEK
RIAIWGWSYGGYVSSLALASGTGLFKCGIAVAPVSSWEYYASVYTERFMGLPTKDDNLEHYKNSTVMARAEYFRNVD
YLLIHGTADDNVHFQNSAQIAKALVNAQVDFQAMWYSDQNHGLSGLSTNHLYTHMTHFLKQCFSLSD

FIGURE 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

FIGURE 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

FIGURE 3C

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIGURE 3D

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

FIGURE 3E

| Monomer 1 | Monomer 2 |
| --- | --- |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |

FIGURE 3F

| Monomer 1 | Monomer 2 |
|---|---|
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIGURE 4

| Variant constant region | Substitutions |
|---|---|
| pI-ISO(-) | I199T/N203D/K274Q/R355Q/N384S/K392N/N397M/Q419E/K447_ |
| pI_ISO(-)-Fc only | K274Q/R355Q/N384S/K392N/V397M/Q419E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

FIGURE 5

Ablation Variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

FIGURE 6

| scFv monomer (+), e.g., scFv-Fc or Fab-scFv-Fc or Fab-scFv-Fc | Fab monomer (-), e.g., Fab-Fc |
|---|---|
| Heterodimer skew variants S364K/E357Q | Heterodimerization skew variants L368D/K370S |
| Optional scFv charged linker including but not limited to (GKPGS)4 (SEQ ID NO: 4) (See Figure 7 for additional charged linekrs) | Isosteric pI variant N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |

FIGURE 7

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 5 |
| Whitlow linker | GSTSGSGKPGSGEGSTKG | 18 | +1 | 6 |
| 6paxA_1 (+A) | IRPRAIGGSKPRVA | 14 | +4 | 7 |
| +B | GKGGSGKGGSGKGGS | 15 | +3 | 8 |
| +C | GGKGSGGKGSGGKGS | 15 | +3 | 9 |
| +D | GGGKSGGGKSGGGKS | 15 | +3 | 10 |
| +E | GKGKSGKGKSGKGKS | 15 | +6 | 11 |
| +F | GGGKSGGKGSGKGGS | 15 | +3 | 12 |
| +G | GKPGSGKPGSGKPGS | 15 | +3 | 13 |
| +H | GKPGSGKPGSGKPGSGKPGS | 20 | +4 | 4 |
| +I | GKGKSGKGKSGKGKSGKGKS | 20 | +8 | 14 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 15 |
| 3hsc_2 (-A) | STAGDTHLGGEDFD | 14 | -4 | 16 |
| -B | GEGGSGEGGSGEGGS | 15 | -3 | 17 |
| -C | GGEGSGGEGSGGEGS | 15 | -3 | 18 |
| -D | GGGESGGGESGGGES | 15 | -3 | 19 |
| -E | GEGESGEGESGEGES | 15 | -6 | 20 |
| -F | GGGESGGEGSGEGGS | 15 | -3 | 21 |
| -G | GEGESGEGESGEGESGEGES | 20 | -8 | 22 |

Additional scFv Linkers

| Sequence | SEQ ID |
|---|---|
| GGGGSGGGGSGGGGS | SEQ ID NO:5 |
| GGGGSGGGGSGGGGSGGGGS | SEQ ID NO:15 |
| GSTSGSGKPGSGEGSTKG | SEQ ID NO:6 |
| PRGASKSGSASQTGSAPGS | SEQ ID NO:23 |
| GTAAAGAGAAGGAAAGAAG | SEQ ID NO:24 |
| GTSGSSGSGSGGSGSGGG | SEQ ID NO:25 |
| GKPGSGKPGSGKPGSGKPGS | SEQ ID NO:4 |

Useful domain linkers

| | |
|---|---|
| KTHTCPPCP ("half hinge") | SEQ ID NO:26 |
| EPKSSDKTHTCPPCP ("full hinge C220S variant") | SEQ ID NO:27 |
| GGGGSGGGGSKTHTCPPCP ("flex half hinge") | SEQ ID NO:28 |
| GKPGSGKPGSKTHTCPPCP ("charged half hinge1") | SEQ ID NO:29 |
| GKPGSKTHTCPPCP ("charged half hinge2") | SEQ ID NO:30 |

FIGURE 8

| XENP | Heterodimer-skew variant, Chain 1 | Heterodimer-skew variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

FIGURE 9A

1 + 1 Fab-scFv-Fc Backbone 1

>Fab-Fc Side (SEQ ID NO: 31)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK

>scFv-Fc Side (SEQ ID NO: 32)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

1 + 1 Fab-scFv-Fc Backbone 2

>Fab-Fc Side (SEQ ID NO: 33)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK

>scFv-Fc Side (SEQ ID NO: 34)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

1 + 1 Fab-scFv-Fc Backbone 3

>Fab-Fc Side (SEQ ID NO: 35)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCEVSGFYPSDIAVEWESDGQPENNYKTTPPVLDSDGSFFLYSKLTVDKSRWEQGDVFSC
SVMHEALHNHYTQKSLSLSPGK

>scFv-Fc Side (SEQ ID NO: 36)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

1 + 1 Fab-scFv-Fc Backbone 4

>Fab-Fc Side (SEQ ID NO: 37)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTENEVSLTCLVKGFYPSDIAVEWESDGQPENNYKTTPPVLDSDGSFFLYSKLEVDKSRWEQGDVFSC
SVMHEALHNHYTQKSLSLSPGK

FIGURE 9B

>scFv-Fc Side (SEQ ID NO: 38)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVSLTCLV
KGFYPSDIAVEWESNGQPENNYKTTPPVLDSKGSFFLYSKLTVDKSRWQQGNVFSCSVMHEALHNHYTQKSLSLSPG
K

1 + 1 Fab-scFv-Fc Backbone 5

>Fab-Fc Side (SEQ ID NO: 39)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSRDELTKNQVSLTCDVSGFYPSDIAVEWESDGQPENNYKTTPPVLDSDGSFFLYSKLTVDKSRWEQGDVFSC
SVMHEALHNHYTQKSLSLSPGK >scFv-Fc Side (SEQ ID NO: 40)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSRDQLTKNQVKLTCLV
KGFYPSDIAVEWESNGQPENNYKTTPPVLDSDGSFFLYSKLTVDKSRWQQGNVFSCSVMHEALHNHYTQKSLSLSPG
K

1 + 1 Fab-scFv-Fc Backbone 6

>Fab-Fc Side (SEQ ID NO: 41)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYASTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK >scFv-Fc Side (SEQ ID NO: 42)
/EPKSSDKTHTCPPCPAPPVAGPSVFLFPPKPKDTLMISRTPEVTCVVVDVKHEDPEVKFNWYVDGVEVHNAKTKPR
EEQYASTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

1 + 1 Fab-scFv-Fc Backbone 7

>Fab-Fc Side (SEQ ID NO: 43)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYSSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK >scFv-Fc Side (SEQ ID NO: 44)
/EPKSSDKTHTCPPCPAPPVAGPSVFLFPPKPKDTLMISRTPEVTCVVVDVKHEDPEVKFNWYVDGVEVHNAKTKPR
EEQYSSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

FIGURE 9C

1 + 1 Fab-scFv-Fc Backbone 8

>Fab-Fc Side (SEQ ID NO: 45)
/ASTKGPSVFPLAPCSRSTSESTAALGCLVKDYFPEPVTVSWNSGALTSGVHTFPAVLQSSGLYSLSSVVTVPSSSL
GTKTYTCNVDHKPSDTKVDKRVESKYGPPCPPCPAPEFLGGPSVFLFPPKPKDTLMISRTPEVTCVVVDVSQEDPEV
QFNWYVDGVEVHNAKTKPREEEFNSTYRVVSVLTVLHQDWLNGKEYKCKVSNKGLPSSIEKTISKAKGQPREPQVYT
LPPSQEEMTKNQVSLTCDVSGFYPSDIAVEWESDGQPENNYKTTPPVLDSDGSFFLYSRLTVDKSRWEEGDVFSCSV
MHEALHNHYTQKSLSLSLGK

>scFv-Fc Side (SEQ ID NO: 46)
/ESKYGPPCPPCPAPEFLGGPSVFLFPPKPKDTLMISRTPEVTCVVVDVSQEDPEVQFNWYVDGVEVHNAKTKPREE
QFNSTYRVVSVLTVLHQDWLNGKEYKCKVSNKGLPSSIEKTISKAKGQPREPQVYTLPPSQEQMTKNQVKLTCLVKG
FYPSDIAVEWESNGQPENNYKTTPPVLDSDGSFFLYSRLTVDKSRWQEGNVFSCSVMHEALHNHYTQKSLSLSLGK

1 + 1 Fab-scFv-Fc Backbone 9

>Fab-Fc Side (SEQ ID NO: 47)
/ASTKGPSVFPLAPCSRSTSESTAALGCLVKDYFPEPVTVSWNSGALTSGVHTFPAVLQSSGLYSLSSVVTVPSSNF
GTQTYTCNVDHKPSDTKVDKTVERKCCVECPPCPAPPVAGPSVFLFPPKPKDTLMISRTPEVTCVVVDVSHEDPEVQ
FNWYVDGVEVHNAKTKPREEEFNSTFRVVSVLTVVHQDWLNGKEYKCKVSNKGLPAPIEKTISKTKGQPREPQVYTL
PPSREEMTKNQVSLTCDVSGFYPSDIAVEWESDGQPENNYKTTPPMLDSDGSFFLYSKLTVDKSRWEQGDVFSCSVM
HEALHNHYTQKSLSLSPGK

>scFv-Fc Side (SEQ ID NO: 48)
/ERKCCVECPPCPAPPVAGPSVFLFPPKPKDTLMISRTPEVTCVVVDVSHEDPEVQFNWYVDGVEVHNAKTKPREEQ
FNSTFRVVSVLTVVHQDWLNGKEYKCKVSNKGLPAPIEKTISKTKGQPREPQVYTLPPSREQMTKNQVKLTCLVKGF
YPSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 10

>Fab-Fc Side (SEQ ID NO: 49)
/ASTKGPSVFPLAPCSRSTSESTAALGCLVKDYFPEPVTVSWNSGALTSGVHTFPAVLQSSGLYSLSSVVTVPSSNF
GTQTYTCNVDHKPSDTKVDKTVERKCCVECPPCPAPPVAGPSVFLFPPKPKDTLMISRTPEVTCVVVDVKHEDPEVQ
FNWYVDGVEVHNAKTKPREEEFNSTFRVVSVLTVVHQDWLNGKEYKCKVSNKGLPAPIEKTISKTKGQPREPQVYTL
PPSREEMTKNQVSLTCDVSGFYPSDIAVEWESDGQPENNYKTTPPMLDSDGSFFLYSKLTVDKSRWEQGDVFSCSVM
HEALHNHYTQKSLSLSPGK

>scFv-Fc Side (SEQ ID NO: 50)
/ERKCCVECPPCPAPPVAGPSVFLFPPKPKDTLMISRTPEVTCVVVDVKHEDPEVQFNWYVDGVEVHNAKTKPREEQ
FNSTFRVVSVLTVVHQDWLNGKEYKCKVSNKGLPAPIEKTISKTKGQPREPQVYTLPPSREQMTKNQVKLTCLVKGF
YPSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 11

>Fab-Fc Side (SEQ ID NO: 51)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVLHEALHSHYTQKSLSLSPGK

FIGURE 9D

>scFv-Fc Side (SEQ ID NO: 52)
/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLSPG
K

1 + 1 Fab-scFv-Fc Backbone 12

>Fab-Fc Side (SEQ ID NO: 53)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREPQV
YTLPPSREEMTKNQVSLTCDVAGFYPSDIAVEWESNGQPENNYKTTPPVLDSDGSFFLYSKLTVDKSRWQQGNVFSC
SVMHEALHNHYTQKSLSLSPGK

>scFv-Fc Side (SEQ ID NO: 54)
/ERKSSDKTHTCPPRPAPPVAGPSVFLFPPKPKDTLMISRTPEVTCVVVDVKHEDPEVKFKWYVDGVEVHNAKTKPR
EEQYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLSPG
K

FIGURE 10A

2 + 1 Fab2-scFv-Fc Backbone 1

>Fab-Fc Side (SEQ ID NO: 55)
(VH domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWE
QGDVFSCSVMHEALHNHYTQKSLSLSPGK

>Fab-scFv-Fc Side (SEQ ID NO: 56)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

2 + 1 Fab2-scFv-Fc Backbone 2

>Fab-Fc Side (SEQ ID NO: 57)
(VH domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWE
QGDVFSCSVMHEALHNHYTQKSLSLSPGK

>Fab-scFv-Fc Side (SEQ ID NO: 58)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

2 + 1 Fab2-scFv-Fc Backbone 3

>Fab-Fc Side (SEQ ID NO: 59)
(VH domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTKNQVSLTCEVSGFYPSDIAVEWESDGQPENNYKTTPPVLDSDGSFFLYSKLTVDKSRWE
QGDVFSCSVMHEALHNHYTQKSLSLSPGK

>Fab-scFv-Fc Side (SEQ ID NO: 60)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

FIGURE 10B

2 + 1 Fab2-scFv-Fc Backbone 4

>Fab-Fc Side (SEQ ID NO: 61)
(VH
domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTENEVSLTCLVKGFYPSDIAVEWESDGQPENNYKTTPPVLDSDGSFFLYSKLEVDKSRWE
QGDVFSCSVMHEALHNHYTQKSLSLSPGK

>Fab-scFv-Fc Side (SEQ ID NO: 62)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSKGSFFLYSKLTVDKSRWQQGNVFSCSVMHEALHNHYTQKSLSLSPGK

2 + 1 Fab2-scFv-Fc Backbone 5

>Fab-Fc Side (SEQ ID NO: 63)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSRDELTKNQVSLTCDVSGFYPSDIAVEWESDGQPENNYKTTPPVLDSDGSFFLYSKLTVDKSRWEQGDVFSC
SVMHEALHNHYTQKSLSLSPGK

>Fab-scFv-Fc Side (SEQ ID NO: 64)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSRDQLTKNQVKLTCLVKGFYPSDIAVEWE
SNGQPENNYKTTPPVLDSDGSFFLYSKLTVDKSRWQQGNVFSCSVMHEALHNHYTQKSLSLSPGK

2 + 1 Fab2-scFv-Fc Backbone 6

>Fab-Fc Side (SEQ ID NO: 65)
(VH
domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYASTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWE
QGDVFSCSVMHEALHNHYTQKSLSLSPGK

>Fab-scFv-Fc Side (SEQ ID NO: 66)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYASTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

FIGURE 10C

<u>2 + 1 Fab2-scFv-Fc Backbone 7</u>

>Fab-Fc Side (SEQ ID NO: 67)
(VH
domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYSSTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWE
QGDVFSCSVMHEALHNHYTQKSLSLSPGK

>Fab-scFv-Fc Side (SEQ ID NO: 68)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYSSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK <u>2 + 1 Fab2-scFv-Fc Backbone 8</u>

>Fab-Fc Side (SEQ ID NO: 69)
(VH
domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSDTKVDKKVEPKSCDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKAKG
QPREPQVYTLPPSREEMTKNQVSLTCDVSGFYPSDIAVEWESDGQPENNYKTTPPVLDSDGSFFLYSKLTVDKSRWE
QGDVFSCSVLHEALHSHYTQKSLSLSPGK

>Fab-scFv-Fc Side (SEQ ID NO: 70)
(VH-CH1-domain linker 1-scFv-domain linker
2)/APPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK <u>2 + 1 Fab2-scFv-Fc Backbone 9</u>

>Fab-Fc Side (SEQ ID NO: 71)
(VH
domain)/ASTKGPSVFPLAPSSKSTSGGTAALGCLVKDYFPEPVTVSWNSGALTSGVHTFPAVLQSSGLYSLSSVV
TVPSSSLGTQTYICNVNHKPSNTKVDKKVEPKSCDKTHTCPPCPAPPVAGPSVFLFPPKPKDTLMISRTPEVTCVVV
DVKHEDPEVKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCDVAGFYPSDIAVEWESNGQPENNYKTTPPVLDSDGSFFLYSKLTVDKSRWQ
QGNVFSCSVMHEALHNHYTQKSLSLSPGK

>Fab-scFv-Fc Side (SEQ ID NO: 72)
(VH-CH1-domain linker 1-scFv-domain linker
2)/APPVAGPSVFLFPPKPKDTLMISRTPEVTCVVVDVKHEDPEVKFKWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

FIGURE 11

Constant Light Chain – Kappa SEQ ID NO:74
RTVAAPSVFIFPPSDEQLKSGTASVVCLLNNFYPREAKVQWKVDNALQSGNSQESVTEQDSKDSTYSLSSTLTLSKA
DYEKHKVYACEVTHQGLSSPVTKSFNRGEC

Constant Light Chain – Lambda SEQ ID NO:75
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

FIGURE 12A

High CD3: Anti-CD3_H1.30_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | 73 |
| vhCDR1 | TYAMN | 76 |
| vhCDR2 | RIRSKYNNYATYYADSVKG | 77 |
| vhCDR3 | HGNFGDSYVSWFAY | 78 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 79 |
| vlCDR1 | GSSTGAVTTSNYAN | 80 |
| vlCDR2 | GTNKRAP | 81 |
| vlCDR3 | ALWYSNHWV | 82 |
| scFv (VH-scFv linker-VL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 83 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS | 84 |

FIGURE 12B

High-Int #1 CD3: Anti-CD3_H1.32_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | 85 |
| vhCDR1 | TYAMN | 86 |
| vhCDR2 | RIRSKANNYATYYADSVKG | 87 |
| vhCDR3 | HGNFGDSYVSWFAY | 88 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL | 89 |
| vlCDR1 | GSSTGAVTTSNYAN | 90 |
| vlCDR2 | GTNKRAP | 91 |
| vlCDR3 | ALWYSNHWV | 92 |
| scFv (VH-scFv linker-VL) | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS/GKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL | 93 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL/GKPGSGKPGSGKPGS/EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | 94 |

FIGURE 12C

High-Int #2 CD3: Anti-CD3_H1.89_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | 95 |
| vhCDR1 | TYAMN | 96 |
| vhCDR2 | RIRSKYNNYATYYADSVKG | 97 |
| vhCDR3 | HGNFGDEYVSWFAY | 98 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL | 99 |
| vlCDR1 | GSSTGAVTTSNYAN | 100 |
| vlCDR2 | GTNKRAP | 101 |
| vlCDR3 | ALWYSNHWV | 102 |
| scFv (VH-scFv linker-VL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS/GKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL | 103 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYCALWYSNHWVFGGGTKLTVL/GKPGSGKPGSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | 104 |

FIGURE 12D

High-Int #3 CD3: Anti-CD3_H1.90_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | 105 |
| vhCDR1 | TYAMN | 106 |
| vhCDR2 | RIRSKYNNYATYYADSVKG | 107 |
| vhCDR3 | HGNFGDPYVSWFAY | 108 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 109 |
| vlCDR1 | GSSTGAVTTSNYAN | 110 |
| vlCDR2 | GTNKRAP | 111 |
| vlCDR3 | ALWYSNHWV | 112 |
| scFv (VH-scFv linker-VL) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS/GKPGSGKPGSSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 113 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSSGKPGS/EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | 114 |

FIGURE 12E

Intermediate CD3: Anti-CD3_H1.33_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRA EDTAVYYCVRHGNFGDSYVSWFDYWGQGTLVTVSS | 115 |
| vhCDR1 | TYAMN | 116 |
| vhCDR2 | RIRSKYNNYATYYADSVKG | 117 |
| vhCDR3 | HGNFGDSYVSWFDY | 118 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYCA LWYSNHWVFGGGTKLTVL | 119 |
| vlCDR1 | GSSTGAVTTSNYAN | 120 |
| vlCDR2 | GTNKRAP | 121 |
| vlCDR3 | ALWYSNHWV | 122 |
| scFv (VH-scFv linker-VL) | EVQLVESGGGLVQPGGSLRLSCAASGFTFSTYAMNWVRQAPGKGLEWVGRIRSKYNNYATYYADSVKGRFTISRDDSKNTLYLQMNSLRA EDTAVYYCVRHGNFGDSYVSWFDYWGQGTLVTVSS/GKPGSGKPGSSGKPGS/QAVVTQEPSLTVSPGGTVTLTCGSSTGAVTTSN YANWVQQKPGKSPRGLIGGTNKRAPGVPARFSGSLLGGKAALTISGAQPEDEADYYCALWYSNHWVFGGGTKLTVL | 123 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYCA LWYSNHWVFGGGTKLTVL/GKPGSGKPGSSGKPGS/EVQLVESGGGLVQPGGSLRLSCAASGFTFSTYAMNWVRQAPGKGLEWV GRIRSKYNNYATYYADSVKGRFTISRDDSKNTLYLQMNSLRAEDTAVYYCVRHGNFGDSYVSWFDYWGQGTLVTVSS | 124 |

FIGURE 12F

Low CD3: Anti-CD3_H1.31_L1.47

| What | sequence | SEQ ID NO: |
|---|---|---|
| Variable heavy (vh) domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | 125 |
| vhCDR1 | TYAMS | 126 |
| vhCDR2 | RIRSKYNNYATYYADSVKG | 127 |
| vhCDR3 | HGNFGDSYVSWFAY | 128 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 129 |
| vlCDR1 | GSSTGAVTTSNYAN | 130 |
| vlCDR2 | GTNKRAP | 131 |
| vlCDR3 | ALWYSNHWV | 132 |
| scFv (VH-scFv linker-VL)) | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS/GKPGSSGKPGSSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 133 |
| scFv (VL-scFv linker-VH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSSGKPGSSGKPGS/EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | 134 |

FIGURE 13

>XENP023534 sibrotuzumab[FAP]_H0L0_IgG1_PVA_/S267K

*XENP023534 sibrotuzumab[FAP]_H0L0_IgG1_PVA_/S267K Heavy Chain (SEQ ID NO: 135)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNSTYR
VVSVLTVLHQDWLNGKEYKCKVSNKALPAPIEKTISKAKGQPREPQVYTLPPSREEMTKNQVSLTCLVKGFYPSDIA
VEWESNGQPENNYKTTPPVLDSDGSFFLYSKLTVDKSRWQQGNVFSCSVMHEALHNHYTQKSLSLSPGK

*XENP023534 sibrotuzumab[FAP]_H0L0_IgG1_PVA_/S267K Light Chain (SEQ ID NO: 136)*

DIVMTQSPDSLAVSLGERATINCKSSQSLLYSPNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP023929 29B11[FAP]_H0L0_IgG1_PVA_/S267K

*XENP023929 29B11[FAP]_H0L0_IgG1_PVA_/S267K Heavy Chain (SEQ ID NO: 137)*

EVQLLESGGGLVQPGGSLRLSCAASGFTFSSYAMSWVRQAPGKGLEWVSAIIGSGGITYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

*XENP023929 29B11[FAP]_H0L0_IgG1_PVA_/S267K Light Chain (SEQ ID NO: 138)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP023933 3F2[FAP]_H0L0_IgG1_PVA_/S267K

*XENP023933 3F2[FAP]_H0L0_IgG1_PVA_/S267K Heavy Chain (SEQ ID NO: 139)*

EVQLLESGGGLVQPGGSLRLSCAASGFTFSSYAMSWVRQAPGKGLEWVSAISGSGGSTYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

*XENP023933 3F2[FAP]_H0L0_IgG1_PVA_/S267K Light Chain (SEQ ID NO: 140)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

FIGURE 14A

1A4A5[FAP]_H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKDAGRPYFDYWGQGTLVTVSS | 141 |
| vhCDR1 | SYAMS | 142 |
| vhCDR2 | AISGSGGTTYYADSVKG | 143 |
| vhCDR3 | DAGRPYFD | 144 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYKFPYTFGQGTKLEI | 145 |
| vlCDR1 | RASQSISSYLN | 146 |
| vlCDR2 | AASSLQS | 147 |
| vlCDR3 | QQSYKFPYT | 148 |

FIGURE 14B

1C3A5 [FAP] H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSAISGSGGGTRYADSVKGRFTISRDNSKNTLYLQ MNSLRAEDTAVYYCAKHSSGFHWYFDYWGQGTLVTVSS | 149 |
| vhCDR1 | SYAMS | 150 |
| vhCDR2 | AISGSGGGTRYADSVKG | 151 |
| vhCDR3 | HSSGFHWYFDY | 152 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPRTFGQGTKLEIK | 153 |
| vlCDR1 | RASQSISSYL | 154 |
| vlCDR2 | AASSLQS | 155 |
| vlCDR3 | QQSYSTPRT | 156 |

FIGURE 14C

1E5A5[FAP] H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSGISGSGGSTYYADSVKGRFTISRDNSKNTLYLQ MNSLRAEDTAVYYCAKISFYPGGTYFDYWGQGTLVTVSS | 157 |
| vhCDR1 | SYAMS | 158 |
| vhCDR2 | GISGSGGSTYYADSVKG | 159 |
| vhCDR3 | ISFYPGGTYFDY | 160 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSSPYTFGQGTKLEIK | 161 |
| vlCDR1 | RASQSISSYLN | 162 |
| vlCDR2 | AASSLQS | 163 |
| vlCDR3 | QQSYSSPYT | 164 |

FIGURE 14D

1E5A5(COMMONLC)[FAP] H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSGISGSGGSTYYADSVKGRFTISRDNSKNTLYLQ MNSLRAEDTAVYYCAKISFYPGGTYFDYWGQGTLVTVSS | 165 |
| vhCDR1 | SYAMS | 166 |
| vhCDR2 | GISGSGGSTYYADSVKG | 167 |
| vhCDR3 | ISFYPGGTYFDY | 168 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPYTFGQGTKLEIK | 169 |
| vlCDR1 | RASQSISSYLN | 170 |
| vlCDR2 | AASSLQS | 171 |
| vlCDR3 | QQSYSTPYT | 172 |

FIGURE 14E

1A1B5[FAP] H1L1

| What | sequence | SEQ ID NO: |
|---|---|---|
| Variable heavy (vh) domain | EVQLLESGGGLVQPGGSLRLSCAASGFTFSSYAMNWVRQAPGKGLEWVSTISSSGSRTYYADSVKGRFTISRDNSKNTLYLQM NSLRAEDTAVYYCAKGLVASAPFDYWGQGTLVTVSS | 173 |
| vhCDR1 | SYAMN | 174 |
| vhCDR2 | TISSSGSRTYYADSVKG | 175 |
| vhCDR3 | GLVASAPFD | 176 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPYTFGQGTKLEIK | 177 |
| vlCDR1 | RASQSISSYLN | 178 |
| vlCDR2 | AASSLQS | 179 |
| vlCDR3 | QQSYSTPYT | 180 |

FIGURE 14F

1A7B5[FAP] H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSS | 181 |
| vhCDR1 | SYAMS | 182 |
| vhCDR2 | GISGGGGSTYYADSVKG | 183 |
| vhCDR3 | IAHSRIGWHFDY | 184 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK | 185 |
| vlCDR1 | RASQSISSYLN | 186 |
| vlCDR2 | AASSLQS | 187 |
| vlCDR3 | QQSYSTPYT | 188 |

FIGURE 14G

1F4B5[FAP] H1L1

| What | sequence | SEQ ID NO: |
|---|---|---|
| Variable heavy (vh) domain | EVQLLESGGGLVQPGGSLRLSCAASGFTFSRYAMTWVRQAPGKGLEWVSSISASGGSTYYADSVKGRFTISRDNSKNTLYLQ MNSLRAEDTAVYYCAKTFSGYAHYDFDYWGQGTLVTVSS | 189 |
| vhCDR1 | RYAM | 190 |
| vhCDR2 | SISASGGSTYYADSVKG | 191 |
| vhCDR3 | TFSGYAHYDFDY | 192 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPYTFGQGTKLEIK | 193 |
| vlCDR1 | RASQSISSYLN | 194 |
| vlCDR2 | AASSLQS | 195 |
| vlCDR3 | QQSYSTPYT | 196 |

FIGURE 14H

1F11B5[FAP] H1L1

| What | sequence | SEQ ID NO: |
|---|---|---|
| Variable heavy (vh) domain | EVQLLESGGGLVQPGGSLRLSCAASGFTFSSYAMNWVRQAPGKGLEWVSGISGGGSSTTYYADSVKGRFTISRDNSKNTLYLQMNSLRAEDTAVYYCAKPYYWVDSFFDYWGQGTLVTVSS | 197 |
| vhCDR1 | SYAMN | 198 |
| vhCDR2 | GISGGGSSTTYYADSVKG | 199 |
| vhCDR3 | PYYWVDSFFDY | 200 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK | 201 |
| vlCDR1 | RASQSISSYLN | 202 |
| vlCDR2 | AASSLQS | 203 |
| vlCDR3 | QQSYSTPYT | 204 |

FIGURE 14I

1F12B5[FAP] H1L1

| What | sequence | SEQ ID NO: |
|---|---|---|
| Variable heavy (vh) domain | EVQLLESGGGLVQPGGSLRLSCAASGFTFSSYAMTWVRQAPGKGLEWVSTISSSGGTTYYADSVKGRFTISRDNSKNTLYLQM NSLRAEDTAVYYCAKYPSYSVTGFDYWGQGTLVTVSS | 205 |
| vhCDR1 | SYAMT | 206 |
| vhCDR2 | TISSSGGTTYYADSVKG | 207 |
| vhCDR3 | YPSYSVTGFDY | 208 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPYTFGQGTKLEIK | 209 |
| vlCDR1 | RASQSISSYLN | 210 |
| vlCDR2 | AASSLQS | 211 |
| vlCDR3 | QQSYSTPYT | 212 |

FIGURE 14J

1D5B5[FAP]_H1L1

| What | sequence | SEQ ID NO: |
|---|---|---|
| Variable heavy (vh) domain | EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKVGFFGLSWGFDYWGQGTLVTVSS | 213 |
| vhCDR1 | SYAMS | 214 |
| vhCDR2 | GISGSGGSTYYADSVKG | 215 |
| vhCDR3 | VGFFGLSWGFDY | 216 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK | 217 |
| vlCDR1 | RASQSISSYLN | 218 |
| vlCDR2 | AASSLQS | 219 |
| vlCDR3 | QQSYSTPYT | 220 |

FIGURE 14K

1F10B5[FAP]_H1L1

| What | sequence | SEQ ID NO: |
|---|---|---|
| Variable heavy (vh) domain | EVQLLESGGGLVQPGGSLRLSCAASGFTFSSYGMSWVRQAPGKGLEWVSGISGSGSSTHYADSVKGRFTISRDNSKNTLYLQ MNSLRAEDTAVYYCAKGTTGLSYFDYWGQGTLVTVSS | 221 |
| vhCDR1 | SYGMS | 222 |
| vhCDR2 | GISGSGSSTHYADSVKG | 223 |
| vhCDR3 | GTTGLSYFD | 224 |
| Variable light (vl) domain | DIQMTQSPSSLSASVGDRVTITCRASQSISSYLNWYQQKPGKAPKLLIYAASSLQSGVPSRFSGSGSGTDFTLTISSLQPEDFATY YCQQSYSTPYTFGQGTKLEIK | 225 |
| vlCDR1 | RASQSISSYLN | 226 |
| vlCDR2 | AASSLQS | 227 |
| vlCDR3 | QQSYSTPYT | 228 |

FIGURE 14L

[αFAP] H0.26L0

| What | sequence | SEQ ID NO: |
|---|---|---|
| Variable heavy (vh) domain | QVQLVQSGAEVKKPGASVKVSCKTSRYTFTEYSIHWVRQAPGQRLEWIGGINPNTGIPNYNQKFKGRVTITVDTSASTAYMEL SSLRSEDTAVYYCARRRIAYGYDEGHAMDYWGQGTLVTVSS | 229 |
| vhCDR1 | EYSIH | 230 |
| vhCDR2 | GINPNTGIPNYNQKFKG | 231 |
| vhCDR3 | RRIAYGYDEGHAMDY | 232 |
| Variable light (vl) domain | DIVMTQSPDSLAVSLGERATINCKSSQSLLYSRNQKNYLAWYQQKPGQPPKLLIFWASTRESGVPDRFSGSGFGTDFTLTISSL QAEDVAVYYCQQYFSYPLTFGQGTKVEIK | 233 |
| vlCDR1 | KSSQSLLYSRNQKNYLA | 234 |
| vlCDR2 | WASTRES | 235 |
| vlCDR3 | QQYFSYPLT | 236 |

FIGURE 14M

[αFAP] H0.26L0.11

| What | sequence | SEQ ID NO: |
|---|---|---|
| Variable heavy (vh) domain | QVQLVQSGAEVKKPGASVKVSCKTSRYTFTEYSIHWVRQAPGQRLEWIGGINPNTGIPNYNQKFKGRVTITVDTSASTAYMEL SSLRSEDTAVYYCARRRIAYGYDEGHAMDYWGQGTLVTSS | 237 |
| vhCDR1 | EYSIH | 238 |
| vhCDR2 | GINPNTGIPNYNQKFKG | 239 |
| vhCDR3 | RRIAYGYDEGHAMDY | 240 |
| Variable light (vl) domain | DIVMTQSPDSLAVSLGERATINCKSSQSLLYSSNQKNYLAWYQQKPGQPPKLLIFWASTRESGVPDRFSGSGFGTDFTLTISSLQ AEDVAVYYCQQYFSYPLTFGQGTKVEIK | 241 |
| vlCDR1 | KSSQSLLYSSNQKNYLA | 242 |
| vlCDR2 | WASTRES | 243 |
| vlCDR3 | QQYFSYPLT | 244 |

FIGURE 14N

[αFAP] H0.26L0.19

| What | sequence | SEQ ID NO: |
|---|---|---|
| Variable heavy (vh) domain | QVQLVQSGAEVKKPGASVKVSCKTSRYTFTEYSIHWVRQAPGQRLEWIGGINPNTGIPNYNQKFKGRVTITVDTSASTAYMEL SSLRSEDTAVYYCARRRIAYGYDEGHAMDYWGQGTLVTVSS | 245 |
| vhCDR1 | EYSIH | 246 |
| vhCDR2 | GINPNTGIPNYNQKFKG | 247 |
| vhCDR3 | RRIAYGYDEGHAMDY | 248 |
| Variable light (vl) domain | DIVMTQSPDSLAVSLGERATINCKSSQSLLYSRNQENYLAWYQQKPGQPPKLLIFWASTRESGVPDRFSGSGFGTDFTLTISSL QAEDVAVYYCQQYFSYPLTFGQGTKVEIK | 249 |
| vlCDR1 | KSSQSLLYSRNQENYLA | 250 |
| vlCDR2 | WASTRES | 251 |
| vlCDR3 | QQYFSYPLT | 252 |

FIGURE 15A

>XENP024444 1A4A5[FAP] H1L1 IgG1 PVA /S267K

*XENP024444 1A4A5[FAP]_H1L1_IgG1_PVA_/S267K Heavy Chain (SEQ ID NO: 253)*

EVQLLESGGGLVQPGGSLRLSCAASGFTFSSYAMSWVRQAPGKGLEWVSAISGSGGTTYYADSVKGRFTISRDNSKN
TLYLQMNSLRAEDTAVYYCAKDAGRPYFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPC
PAPPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALHNHYTQKSLSLSPGK

*XENP024444 1A4A5[FAP]_H1L1_IgG1_PVA_/S267K Light Chain (SEQ ID NO: 254)*

DIQMTQSPSSLSASVGDRVTITCRASQSISSYLNWYQQKPGKAPKLLIYAASSLQSGVPSRFSGSGSGTDFTLTISS
LQPEDFATYYCQQSYKFPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024448 1C3A5[FAP] H1L1 IgG1 PVA /S267K

*XENP024448 1C3A5[FAP]_H1L1_IgG1_PVA_/S267K Heavy Chain (SEQ ID NO: 255)*

EVQLLESGGGLVQPGGSLRLSCAASGFTFSSYAMSWVRQAPGKGLEWVSAISGSGGGTRYADSVKGRFTISRDNSKN
TLYLQMNSLRAEDTAVYYCAKHSSGFHWYFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK

*XENP024448 1C3A5[FAP]_H1L1_IgG1_PVA_/S267K Light Chain (SEQ ID NO: 256)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPRTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024454 1E5A5[FAP] H1L1 IgG1 PVA /S267K

*XENP024454 1E5A5[FAP]_H1L1_IgG1_PVA_/S267K Heavy Chain (SEQ ID NO: 257)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024454 1E5A5[FAP]_H1L1_IgG1_PVA_/S267K Light Chain (SEQ ID NO: 258)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSSPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 15B

>XENP024460 1A1B5[FAP] H1L1 IgG1 PVA /S267K

*XENP024460 1A1B5[FAP]_H1L1_IgG1_PVA_/S267K Heavy Chain (SEQ ID NO: 259)*

EVQLLESGGGLVQPGGSLRLSCAASGFTFSSYAMNWVRQAPGKGLEWVSTISSSGSRTYYADSVKGRFTISRDNSKN
TLYLQMNSLRAEDTAVYYCAKGLVASAPFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

*XENP024460 1A1B5[FAP]_H1L1_IgG1_PVA_/S267K Light Chain (SEQ ID NO: 260)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024461 1A7B5[FAP] H1L1 IgG1 PVA /S267K

*XENP024461 1A7B5[FAP]_H1L1_IgG1_PVA_/S267K Heavy Chain (SEQ ID NO: 261)*

EVQLLESGGGLVQPGGSLRLSCAASGFTFSSYAMSWVRQAPGKGLEWVSGISGGGGSTYYADSVKGRFTISRDNSKN
TLYLQMNSLRAEDTAVYYCAKIAHSRIGWHFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024461 1A7B5[FAP]_H1L1_IgG1_PVA_/S267K Light Chain (SEQ ID NO: 262)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024462 1F4B5[FAP] H1L1 IgG1 PVA /S267K

*XENP024462 1F4B5[FAP]_H1L1_IgG1_PVA_/S267K Heavy Chain (SEQ ID NO: 263)*

EVQLLESGGGLVQPGGSLRLSCAASGFTFSRYAMTWVRQAPGKGLEWVSSISASGGSTYYADSVKGRFTISRDNSKN
TLYLQMNSLRAEDTAVYYCAKTFSGYAHYDFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024462 1F4B5[FAP]_H1L1_IgG1_PVA_/S267K Light Chain (SEQ ID NO: 264)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 15C

>XENP024463 1F11B5[FAP] H1L1 IgG1 PVA /S267K

*XENP024463 1F11B5[FAP]_H1L1_IgG1_PVA_/S267K Heavy Chain (SEQ ID NO: 265)*

EVQLLESGGGLVQPGGSLRLSCAASGFTFSSYAMNWVRQAPGKGLEWVSGISGGGSSTTYYADSVKGRFTISRDNSK
NTLYLQMNSLRAEDTAVYYCAKPYYWVDSFFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024463 1F11B5[FAP]_H1L1_IgG1_PVA_/S267K Light Chain (SEQ ID NO: 266)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024466 1F12B5[FAP] H1L1 IgG1 PVA /S267K

*XENP024466 1F12B5[FAP]_H1L1_IgG1_PVA_/S267K Heavy Chain (SEQ ID NO: 267)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024466 1F12B5[FAP]_H1L1_IgG1_PVA_/S267K Light Chain (SEQ ID NO: 268)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024469 1D5B5[FAP] H1L1 IgG1 PVA /S267K

*XENP024469 1D5B5[FAP]_H1L1_IgG1_PVA_/S267K Heavy Chain (SEQ ID NO: 269)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKVGFFGLSWGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

*XENP024469 1D5B5[FAP]_H1L1_IgG1_PVA_/S267K Light Chain (SEQ ID NO: 270)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 15D

>XENP024471 1F10B5[FAP] H1L1 IgG1 PVA /S267K

*XENP024471 1F10B5[FAP]_H1L1_IgG1_PVA_/S267K Heavy Chain (SEQ ID NO: 271)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

*XENP024471 1F10B5[FAP]_H1L1_IgG1_PVA_/S267K Light Chain (SEQ ID NO: 272)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

1+1 Fab-scFv-Fc

2+1 Fab2-scFv-Fc

Figure 17A

>XENP023535 sibrotuzumab[FAP] H0L0 Fab-[anti-CD3] H1.30 L1.47 scFv(GKPGS)4
(SEQ ID NO: 4)-IgG1 pI(-) Isosteric A /PVA /S267K/L368D/K370S-
Fc(216) IgG1 C220S/PVA /S267K/S364K/E357Q XENP023535 sibrotuzumab[FAP]_H0L0_Fab_IgG1_pI(-
)_Isosteric_A_/PVA_/S267K/L368D/K370S Fab-Fc Heavy Chain (SEQ ID NO: 273)

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

XENP023535 [anti-CD3]_H1.30_L1.47_scFv(GKPGS)4 (SEQ ID NO:
4)_Fc(216)_IgG1_C220S/PVA_/S267K/S364K/E357Q scFv-Fc Heavy Chain (SEQ ID NO:
274)

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

XENP023535 sibrotuzumab[FAP]_L0 Light Chain (SEQ ID NO: 275)

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP023536 sibrotuzumab[FAP] H0L0 Fab-[anti-
CD3] H1.32 L1.47 [CD3] scFv(GKPGS)4 (SEQ ID NO: 4)-IgG1 pI(-
) Isosteric A /PVA /S267K/L368D/K370S-
Fc(216) IgG1 C220S/PVA /S267K/S364K/E357Q XENP023536 sibrotuzumab[FAP]_H0L0_Fab_IgG1_pI(-
)_Isosteric_A_/PVA_/S267K/L368D/K370S Fab-Fc Heavy Chain (SEQ ID NO: 276)

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

FIGURE 17B

*XENP023536 [anti-CD3]_H1.32_L1.47_[CD3]_scFv(GKPGS)4 (SEQ ID NO: 4)_Fc(216)_IgG1_C220S/PVA_/S267K/S364K/E357Q scFv-Fc Heavy Chain (SEQ ID NO: 277)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP023536 sibrotuzumab[FAP]_L0 Light Chain (SEQ ID NO: 278)*

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP023930 29B11[FAP]_H0L0 Fab-[anti-CD3]_H1.30_L1.47_scFv(GKPGS)4 (SEQ ID NO: 4)-IgG1_pI(-)_Isosteric_A_/PVA_/S267K/L368D/K370S-Fc(216)_IgG1_C220S/PVA_/S267K/S364K/E357Q

*XENP023930 29B11[FAP]_H0L0_Fab_IgG1_pI(-)_Isosteric_A_/PVA_/S267K/L368D/K370S Fab-Fc Heavy Chain (SEQ ID NO: 279)*

EVQLLESGGGLVQPGGSLRLSCAASGFTFSSYAMSWVRQAPGKGLEWVSAIIGSGGITYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

*XENP023930 [anti-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 280)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP023930 29B11[FAP]_L0 Light Chain (SEQ ID NO: 281)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

FIGURE 17C

>XENP023931 29B11[FAP] H0L0 Fab-[anti-CD3] H1.32 L1.47 [CD3] scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q

*XENP023931 29B11[FAP]_H0L0_Fab_IgG1_pI(-)_Isosteric_A_/PVA_/S267K/L368D/K370S Fab-Fc Heavy Chain (SEQ ID NO: 282)*

EVQLLESGGGLVQPGGSLRLSCAASGFTFSSYAMSWVRQAPGKGLEWVSAIIGSGGITYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

*XENP023931 [anti-CD3]_H1.32_L1.47_[CD3]_scFv(GKPGS)4 (SEQ ID NO: 4)_Fc(216)_IgG1_C220S/PVA_/S267K/S364K/E357Q scFv-Fc Heavy Chain (SEQ ID NO: 283)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP023931 29B11[FAP]_L0 Light Chain (SEQ ID NO: 284)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP023934 3F2[FAP] H0L0 Fab-[anti-CD3] H1.30 L1.47 scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q

*XENP023934 3F2[FAP]_H0L0_Fab_IgG1_pI(-)_Isosteric_A_/PVA_/S267K/L368D/K370S Fab-Fc Heavy Chain (SEQ ID NO: 285)*

EVQLLESGGGLVQPGGSLRLSCAASGFTFSSYAMSWVRQAPGKGLEWVSAISGSGGSTYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

FIGURE 17D

*XENP023934 [anti-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 286)*

EVQLVESGGGLVQPGGSLRLSCAASGFTFS<u>TYAMN</u>WVRQAPGKGLEWVGR<u>IRSKYNNYATYYADSVKG</u>RFTISRDDS
KNTLYLQMNSLRAEDTAVYYCVR<u>HGNFGDSYVSWFAY</u>WGQGTLVTVSS/GKPGSGKPGSGKPGSGKPGS/QAVVTQE
PSLTVSPGGTVTLTC<u>GSSTGAVTTSNYAN</u>WVQQKPGKSPRGLIGG<u>TNKRAP</u>GVPARFSGSLLGGKAALTISGAQPED
EADYYC<u>ALWYSNHWV</u>FGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP023934 3F2[FAP]_L0 Light Chain (SEQ ID NO: 287)*

EIVLTQSPGTLSLSPGERATLSC<u>RASQSVTSSYLA</u>WYQQKPGQAPRLLIN<u>VGSRRAT</u>GIPDRFSGSGSGTDFTLTIS
RLEPEDFAVYYC<u>QQGIMLPPT</u>FGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP023935 3F2[FAP]_H0L0_Fab-[anti-CD3]_H1.32_L1.47_[CD3]_scFv(GKPGS)4 (SEQ ID NO: 4)-IgG1_pI(-)_Isosteric_A_/PVA_/S267K/L368D/K370S-Fc(216)_IgG1_C220S/PVA_/S267K/S364K/E357Q

*XENP023935 3F2[FAP]_H0L0_Fab_IgG1_pI(-)_Isosteric_A_/PVA_/S267K/L368D/K370S Fab-Fc Heavy Chain (SEQ ID NO: 288)*

EVQLLESGGGLVQPGGSLRLSCAASGFTFS<u>SYAMS</u>WVRQAPGKGLEWVS<u>AISGSGGSTYYADSVKG</u>RFTISRDNSKN
TLYLQMNSLRAEDTAVYYCAK<u>GWFGGFNY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

*XENP023935 [anti-CD3]_H1.32_L1.47_[CD3]_scFv(GKPGS)4 (SEQ ID NO: 4)_Fc(216)_IgG1_C220S/PVA_/S267K/S364K/E357Q scFv-Fc Heavy Chain (SEQ ID NO: 289)*

EVQLVESGGGLVQPGGSLRLSCAASGFTFS<u>TYAMN</u>WVRQAPGKGLEWVGR<u>IRSKANNYATYYADSVKG</u>RFTISRDDS
KNTLYLQMNSLRAEDTAVYYCVR<u>HGNFGDSYVSWFAY</u>WGQGTLVTVSS/GKPGSGKPGSGKPGSGKPGS/QAVVTQE
PSLTVSPGGTVTLTC<u>GSSTGAVTTSNYAN</u>WVQQKPGKSPRGLIGG<u>TNKRAP</u>GVPARFSGSLLGGKAALTISGAQPED
EADYYC<u>ALWYSNHWV</u>FGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP023935 3F2[FAP]_L0 Light Chain (SEQ ID NO: 290)*

EIVLTQSPGTLSLSPGERATLSC<u>RASQSVTSSYLA</u>WYQQKPGQAPRLLIN<u>VGSRRAT</u>GIPDRFSGSGSGTDFTLTIS
RLEPEDFAVYYC<u>QQGIMLPPT</u>FGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP024472 sibrotuzumab[FAP]_H0L0_Fab-[anti-CD3]_H1.33_L1.47_scFv(GKPGS)4 (SEQ ID NO: 4)-IgG1_pI(-)_Isosteric_A_/PVA_/S267K/L368D/K370S-Fc(216)_IgG1_C220S/PVA_/S267K/S364K/E357Q

FIGURE 17E

*XENP024472 sibrotuzumab[FAP]_H0L0_Fab_IgG1_pI(-
)_Isosteric_A_/PVA_/S267K/L368D/K370S Fab-Fc Heavy Chain (SEQ ID NO: 291)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

*XENP024472 [anti-CD3]_H1.33_L1.47_scFv(GKPGS)4 (SEQ ID NO:
4)_Fc(216)_IgG1_C220S/PVA_/S267K/S364K/E357Q scFv-Fc Heavy Chain (SEQ ID NO:
292)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFDYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024472 sibrotuzumab[FAP]_L0 Light Chain (SEQ ID NO: 293)*

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

FIGURE 18A

>XENP023932 29B11[FAP] H0L0 Fab-29B11[FAP] H0L0 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP023932 29B11[FAP]_H0L0_Fab_IgG1_PVA_/S267K-pI(-)_Isosteric_A_L368D/K370S Fab-Fc Heavy Chain (SEQ ID NO: 294)*

EVQLLESGGGLVQPGGSLRLSCAASGFTFSSYAMSWVRQAPGKGLEWVSAIIGSGGITYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

*XENP023932 29B11[FAP]_H0L0_Fab_(G2S)2 (SEQ ID NO: 1179)_IgG1_C220S/S364K/E357Q Fab-scFv-Fc Heavy Chain (SEQ ID NO: 295)*

EVQLLESGGGLVQPGGSLRLSCAASGFTFSSYAMSWVRQAPGKGLEWVSAIIGSGGITYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSC/GGGGSGGGG
S/EVQLVESGGGLVQPGGSLRLSCAASGFTFSTYAMNWVRQAPGKGLEWVGRIRSKYNNYATYYADSVKGRFTISRD
DSKNTLYLQMNSLRAEDTAVYYCVRHGNFGDSYVSWFAYWGQGTLVTVSS/GKPGSGKPGSGKPGSGKPGS/QAVVT
QEPSLTVSPGGTVTLTCGSSTGAVTTSNYANWVQQKPGKSPRGLIGGTNKRAPGVPARFSGSLLGGKAALTISGAQP
EDEADYYCALWYSNHWVFGGGTKLTVL/GGGGSGGGGS/KTHTCPPCPAPPVAGPSVFLFPPKPKDTLMISRTPEVT
CVVVDVKHEDPEVKFNWYVDGVEVHNAKTKPREEQYNSTYRVVSVLTVLHQDWLNGKEYKCKVSNKALPAPIEKTIS
KAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

*XENP023932 29B11[FAP]_L0 Light Chain (SEQ ID NO: 296)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP023936 3F2[FAP] H0L0 Fab-3F2[FAP] H0L0 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP023936 3F2[FAP]_H0L0_Fab_IgG1_PVA_/S267K-pI(-)_Isosteric_A_L368D/K370S Fab-Fc Heavy Chain (SEQ ID NO: 297)*

EVQLLESGGGLVQPGGSLRLSCAASGFTFSSYAMSWVRQAPGKGLEWVSAISGSGGSTYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

FIGURE 18B

*XENP023936 3F2[FAP]_H0L0_Fab_(G2S)2 (SEQ ID NO: 1179)_IgG1_C220S/S364K/E357Q Fab-scFv-Fc Heavy Chain (SEQ ID NO: 298)*

EVQLLESGGGLVQPGGSLRLSCAASGFTFSSYAMSWVRQAPGKGLEWVSAISGSGGSTYYADSVKGRFTISRDNSKN
TLYLQMNSLRAEDTAVYYCAKGWFGGFNYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSC/GGGGSGGGG
S/EVQLVESGGGLVQPGGSLRLSCAASGFTFSTYAMNWVRQAPGKGLEWVGRIRSKYNNYATYYADSVKGRFTISRD
DSKNTLYLQMNSLRAEDTAVYYCVRHGNFGDSYVSWFAYWGQGTLVTVSS/GKPGSGKPGSGKPGSGKPGS/QAVVT
QEPSLTVSPGGTVTLTCGSSTGAVTTSNYANWVQQKPGKSPRGLIGGTNKRAPGVPARFSGSLLGGKAALTISGAQP
EDEADYYCALWYSNHWVFGGGTKLTVL/GGGGSGGGGS/KTHTCPPCPAPPVAGPSVFLFPPKPKDTLMISRTPEVT
CVVVDVKHEDPEVKFNWYVDGVEVHNAKTKPREEQYNSTYRVVSVLTVLHQDWLNGKEYKCKVSNKALPAPIEKTIS
KAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

*XENP023936 3F2[FAP]_L0 Light Chain (SEQ ID NO: 299)*

EIVLTQSPGTLSLSPGERATLSCRASQSVTSSYLAWYQQKPGQAPRLLINVGSRRATGIPDRFSGSGSGTDFTLTIS
RLEPEDFAVYYCQQGIMLPPTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP024011 sibrotuzumab[FAP] H0L0 Fab-sibrotuzumab[FAP] H0L0 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP024011 sibrotuzumab[FAP]_H0L0_Fab_IgG1_PVA_/S267K-pI(-)_Isosteric_A_L368D/K370S Fab-Fc Heavy Chain (SEQ ID NO: 300)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

*XENP024011 sibrotuzumab[FAP]_H0L0_Fab_(G2S)2 (SEQ ID NO: 1179)_IgG1_C220S/S364K/E357Q Fab-scFv-Fc Heavy Chain (SEQ ID NO: 301)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSC/GG
GGSGGGGS/EVQLVESGGGLVQPGGSLRLSCAASGFTFSTYAMNWVRQAPGKGLEWVGRIRSKYNNYATYYADSVKG
RFTISRDDSKNTLYLQMNSLRAEDTAVYYCVRHGNFGDSYVSWFAYWGQGTLVTVSS/GKPGSGKPGSGKPGSGKPG
S/QAVVTQEPSLTVSPGGTVTLTCGSSTGAVTTSNYANWVQQKPGKSPRGLIGGTNKRAPGVPARFSGSLLGGKAAL
TISGAQPEDEADYYCALWYSNHWVFGGGTKLTVL/GGGGSGGGGS/KTHTCPPCPAPPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLY
SKLTVDKSRWQQGNVFSCSVMHEALHNHYTQKSLSLSPGK

FIGURE 18C

*XENP024011 sibrotuzumab[FAP]_L0 Light Chain (SEQ ID NO: 302)*

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP024473 sibrotuzumab[FAP] H0L0 Fab-sibrotuzumab[FAP] H0L0 Fab (G4S)2 (SEQ
ID NO: 1174) [ANTI-CD3] H1.32 L1.47 scFv(GKPGS)4 (SEQ ID NO: 4) (G4S)2 (SEQ
ID NO: 1174) IgG1 PVA /S267K-pI(-) Isosteric A L368D/K370S-
IgG1 C220S/S364K/E357Q

*XENP024473 sibrotuzumab[FAP]_H0L0_Fab_IgG1_PVA_/S267K-pI(-
)_Isosteric_A_L368D/K370S Fab-Fc Heavy Chain (SEQ ID NO: 303)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

*XENP024473 sibrotuzumab[FAP]_H0L0_Fab_(G2S)2 (SEQ ID NO:
1179)_IgG1_C220S/S364K/E357Q Fab-scFv-Fc Heavy Chain (SEQ ID NO: 304)*

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSC/GG
GGSGGGGS/EVQLVESGGGLVQPGGSLRLSCAASGFTFSTYAMNWVRQAPGKGLEWVGRIRSKANNYATYYADSVKG
RFTISRDDSKNTLYLQMNSLRAEDTAVYYCVRHGNFGDSYVSWFAYWGQGTLVTVSS/GKPGSGKPGSGKPGSGKPG
S/QAVVTQEPSLTVSPGGTVTLTCGSSTGAVTTSNYANWVQQKPGKSPRGLIGGTNKRAPGVPARFSGSLLGGKAAL
TISGAQPEDEADYYCALWYSNHWVFGGGTKLTVL/GGGGSGGGGS/KTHTCPPCPAPPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLY
SKLTVDKSRWQQGNVFSCSVMHEALHNHYTQKSLSLSPGK

*XENP024473 sibrotuzumab[FAP]_L0 Light Chain (SEQ ID NO: 305)*

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

FIGURE 18D

>XENP024474 sibrotuzumab[FAP] H0L0 Fab-sibrotuzumab[FAP] H0L0 Fab (G4S)2 (SEQ ID NO: 1174) [ANTI-CD3] H1.33 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q XENP024474 sibrotuzumab[FAP]_H0L0_Fab_IgG1_PVA_/S267K-pI(-)_Isosteric_A_L368D/K370S Fab-Fc Heavy Chain (SEQ ID NO: 306)

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNSTYR
VVSVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVMHEALHNHYTQKSLSLSPGK

XENP024474 sibrotuzumab[FAP]_H0L0_Fab_(G2S)2 (SEQ ID NO: 1179)_IgG1_C220S/S364K/E357Q Fab-scFv-Fc Heavy Chain (SEQ ID NO: 307)

QVQLVQSGAEVKKPGASVKVSCKTSRYTFTEYTIHWVRQAPGQRLEWIGGINPNNGIPNYNQKFKGRVTITVDTSAS
TAYMELSSLRSEDTAVYYCARRRIAYGYDEGHAMDYWGQGTLVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSC/GG
GGSGGGGS/EVQLVESGGGLVQPGGSLRLSCAASGFTFSTYAMNWVRQAPGKGLEWVGRIRSKYNNYATYYADSVKG
RFTISRDDSKNTLYLQMNSLRAEDTAVYYCVRHGNFGDSYVSWFDYWGQGTLVTVSS/GKPGSGKPGSGKPGSGKPG
S/QAVVTQEPSLTVSPGGTVTLTCGSSTGAVTTSNYANWVQQKPGKSPRGLIGGTNKRAPGVPARFSGSLLGGKAAL
TISGAQPEDEADYYCALWYSNHWVFGGGTKLTVL/GGGGSGGGGS/KTHTCPPCPAPPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLY
SKLTVDKSRWQQGNVFSCSVMHEALHNHYTQKSLSLSPGK

XENP024474 sibrotuzumab[FAP]_L0 Light Chain (SEQ ID NO: 308)

DIVMTQSPDSLAVSLGERATINCKSSQSLLYSRNQKNYLAWYQQKPGQPPKLLIFWASTRESGVPDRFSGSGFGTDF
TLTISSLQAEDVAVYYCQQYFSYPLTFGQGTKVEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

FIGURE 19

>XENP013245 Numax Fab-[ANTI-CD3] H1.30 L1.47 scFv(GKPGS)4 (SEQ ID NO: 4) Fc(216) IgG1 PVA /S267K pI(-) Isosteric A L368D/K370S-IgG1 C220S/S364K/E357Q

*XENP013245 Numax_Fab_IgG1_C220S/S364K/E357Q Fab-Fc Heavy Chain (SEQ ID NO: 309)*

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

*XENP013245 [ANTI-CD3]_H1.30_L1.47_scFv(GKPGS)4 (SEQ ID NO: 4)_Fc(216)_IgG1_PVA_/S267K_pI(-)_Isosteric_A_L368D/K370S scFv-Fc Heavy Chain (SEQ ID NO: 310)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP013245 Numax_L0 Light Chain (SEQ ID NO: 311)*

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIGURE 20A

>XENP024704 1E5A5[FAP] H1L1 Fab-[ANTI-CD3] H1.30 L1.47 scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q

*XENP024704 1E5A5[FAP]_H1L1_Fab_IgG1_pI(-)_Isosteric_A_/PVA_/S267K/L368D/K370S Fab-Fc Heavy Chain (SEQ ID NO: 312)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP024704 [ANTI-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 313)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024704 1E5A5[FAP]_L1 Light Chain (SEQ ID NO: 314)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSSPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024707 1A7B5[FAP] H1L1 Fab-[ANTI-CD3] H1.30 L1.47 scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q >XENP024707 1A7B5[FAP]_H1L1_Fab_IgG1_pI(-)_Isosteric_A_/PVA_/S267K/L368D/K370S Fab-Fc Heavy Chain (SEQ ID NO: 315)

EVQLLESGGGLVQPGGSLRLSCAASGFTFSSYAMSWVRQAPGKGLEWVSGISGGGGSTYYADSVKGRFTISRDNSKN
TLYLQMNSLRAEDTAVYYCAKIAHSRIGWHFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

FIGURE 20B

>XENP024707 [ANTI-CD3]_H1.30_L1.47_scFv(GKPGS)4 (SEQ ID NO:
4)_IgG1_C220S/PVA_/S267K/S364K/E357Q scFv-Fc Heavy Chain (SEQ ID NO: 316)

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

>XENP024707 1A7B5[FAP]_L1 Light Chain (SEQ ID NO: 317)

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

**>XENP024708 1F4B5[FAP]_H1L1_Fab-[ANTI-CD3]_H1.30_L1.47_scFv(GKPGS)4 (SEQ ID
NO: 4)-IgG1_pI(-)_Isosteric_A_/PVA_/S267K/L368D/K370S-
Fc(216)_IgG1_C220S/PVA_/S267K/S364K/E357Q**

XENP024708 1F4B5[FAP]_H1L1_Fab_IgG1_pI(-)_Isosteric_A_/PVA_/S267K/L368D/K370S
Fab-Fc Heavy Chain (SEQ ID NO: 318)

EVQLLESGGGLVQPGGSLRLSCAASGFTFSRYAMTWVRQAPGKGLEWVSSISASGGSTYYADSVKGRFTISRDNSKN
TLYLQMNSLRAEDTAVYYCAKTFSGYAHYDFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

XENP024708 [ANTI-CD3]_H1.30_L1.47_scFv(GKPGS)4 (SEQ ID NO:
4)_Fc(216)_IgG1_C220S/PVA_/S267K/S364K/E357Q scFv-Fc Heavy Chain (SEQ ID NO:
319)

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

XENP024708 1F4B5[FAP]_L1 Light Chain (SEQ ID NO: 320)

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 20C

>XENP024710 1F12B5[FAP] H1L1 Fab-[ANTI-CD3] H1.30 L1.47 scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q

*XENP024710 1F12B5[FAP]_H1L1_Fab_IgG1_pI(-)_Isosteric_A_/PVA_/S267K/L368D/K370S Fab-Fc Heavy Chain (SEQ ID NO: 321)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP024710 [ANTI-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 322)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024710 1F12B5[FAP]_L1 Light Chain (SEQ ID NO: 323)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024712 1F10B5[FAP] H1L1 Fab-[ANTI-CD3] H1.30 L1.47 scFv(GKPGS)4 (SEQ ID NO: 4)-IgG1 pI(-) Isosteric A /PVA /S267K/L368D/K370S-Fc(216) IgG1 C220S/PVA /S267K/S364K/E357Q

*XENP024712 1F10B5[FAP]_H1L1_Fab_IgG1_pI(-)_Isosteric_A_/PVA_/S267K/L368D/K370S Fab-Fc Heavy Chain (SEQ ID NO: 324)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

FIGURE 20D

*XENP024712 [ANTI-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 325)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024712 1F10B5[FAP]_L1 Light Chain (SEQ ID NO: 326)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP024713 1F12B5[FAP]_H1L1 Fab-[ANTI-CD3]_H1.32_L1.47_scFv(GKPGS)4 (SEQ ID NO: 4)-IgG1_pI(-)_Isosteric_A_/PVA_/S267K/L368D/K370S-Fc(216)_IgG1_C220S/PVA_/S267K/S364K/E357Q

*XENP024713 1F12B5[FAP]_H1L1_Fab_IgG1_pI(-)_Isosteric_A_/PVA_/S267K/L368D/K370S Fab-Fc Heavy Chain (SEQ ID NO: 327)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP024713 [ANTI-CD3]_H1.32_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 328)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024713 1F12B5[FAP]_L1 Light Chain (SEQ ID NO: 329)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 20E

>XENP024715 1F4B5[FAP] H1L1 Fab-[ANTI-CD3] H1.32 L1.47 scFv(GKPGS)4 (SEQ ID
NO: 4)-IgG1 pI(-) Isosteric A /PVA /S267K/L368D/K370S-
Fc(216) IgG1 C220S/PVA /S267K/S364K/E357Q

*XENP024715 1F4B5[FAP]_H1L1_Fab_IgG1_pI(-)_Isosteric_A_/PVA_/S267K/L368D/K370S
Fab-Fc Heavy Chain (SEQ ID NO: 330)*

EVQLLESGGGLVQPGGSLRLSCAASGFTFSRYAMTWVRQAPGKGLEWVSSISASGGSTYYADSVKGRFTISRDNSKN
TLYLQMNSLRAEDTAVYYCAKTFSGYAHYDFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP024715 [ANTI-CD3]_H1.32_L1.47_scFv(GKPGS)4 (SEQ ID NO:
4)_Fc(216)_IgG1_C220S/PVA_/S267K/S364K/E357Q scFv-Fc Heavy Chain (SEQ ID NO:
331)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024715 1F4B5[FAP]_L1 Light Chain (SEQ ID NO: 332)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 20F

>XENP024802 1F10B5[FAP] H1L1 Fab-[ANTI-CD3] H1.32 L1.47 scFv(GKPGS)4 (SEQ ID
NO: 4)-IgG1 pI(-) Isosteric A /PVA /S267K/L368D/K370S-
Fc(216) IgG1 C220S/PVA /S267K/S364K/E357Q

*XENP024802 1F10B5[FAP]_H1L1_Fab_IgG1_pI(-
)_Isosteric_A_/PVA_/S267K/L368D/K370S Fab-Fc Heavy Chain (SEQ ID NO: 333)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

*XENP024802 [ANTI-CD3]_H1.32_L1.47_scFv(GKPGS)4 (SEQ ID NO:
4)_Fc(216)_IgG1_C220S/PVA_/S267K/S364K/E357Q scFv-Fc Heavy Chain (SEQ ID NO:
334)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP024802 1F10B5[FAP]_L1 Light Chain (SEQ ID NO: 335)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025384 1A7B5[FAP] H1L1 Fab-[ANTI-CD3] H1.32 L1.47 scFv(GKPGS)4 (SEQ ID
NO: 4)-IgG1 pI(-) Isosteric A /PVA /S267K/L368D/K370S-
Fc(216) IgG1 C220S/PVA /S267K/S364K/E357Q

*XENP025384 1A7B5[FAP]_H1L1_Fab_IgG1_pI(-)_Isosteric_A_/PVA_/S267K/L368D/K370S
Fab-Fc Heavy Chain (SEQ ID NO: 336)*

EVQLLESGGGLVQPGGSLRLSCAASGFTFSSYAMSWVRQAPGKGLEWVSGISGGGGSTYYADSVKGRFTISRDNSKN
TLYLQMNSLRAEDTAVYYCAKIAHSRIGWHFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

FIGURE 20G

*XENP025384 [ANTI-CD3]_H1.32_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 337)*

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP025384 1A7B5[FAP]_L1 Light Chain (SEQ ID NO: 338)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025965 1E5A5(commonLC)[FAP]_H1L1 Fab-[ANTI-CD3]_H1.30_L1.47_scFv(GKPGS)4 (SEQ ID NO: 4)-IgG1 pI(-) Isosteric A_/PVA_/S267K/L368D/K370S-Fc(216)_IgG1_C220S/PVA_/S267K/S364K/E357Q

*XENP025965 1E5A5(commonLC)[FAP]_H1L1_Fab_IgG1_pI(-)_Isosteric_A_/PVA_/S267K/L368D/K370S Fab-Fc Heavy Chain (SEQ ID NO: 339)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025965 [ANTI-CD3]_H1.30_L1.47_scFv(GKPGS)4 (SEQ ID NO: 4)_Fc(216)_IgG1_C220S/PVA_/S267K/S364K/E357Q scFv-Fc Heavy Chain (SEQ ID NO: 340)*

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

*XENP025965 1E5A5(commonLC)[FAP]_L1 Light Chain (SEQ ID NO: 341)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 21A

>XENP025185 1F12B5[FAP] H1L1 Fab-1F12B5[FAP] H1L1 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025185 1F12B5[FAP]_H1L1_IgG1_PVA_/S267K-pI(-)_Isosteric_A_L368D/K370S Heavy Chain (SEQ ID NO: 342)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025185 1F12B5[FAP]_H1L1_Fab_(G4S)2_(SEQ ID NO: 1174)_[ANTI-CD3]_H1.30_L1.47_scFv(GKPGS)4_(SEQ ID NO: 4)_(G4S)2_(SEQ ID NO: 1174)_IgG1_C220S/S364K/E357Q Fab-scFv-Fc Heavy Chain (SEQ ID NO: 343)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKYNNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025185 1F12B5[FAP]_L1 Light Chain (SEQ ID NO: 344)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025186 1F10B5[FAP] H1L1 Fab-1F10B5[FAP] H1L1 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025186 1F10B5[FAP]_H1L1_IgG1_PVA_/S267K-pI(-)_Isosteric_A_L368D/K370S Heavy Chain (SEQ ID NO: 345)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

FIGURE 21B

*XENP025186 1F10B5[FAP]_H1L1_Fab_(G4S)2 (SEQ ID NO: 1174)_[ANTI-CD3]_H1.30_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 346)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSC/GGGGSGG
GGS/EVQLVESGGGLVQPGGSLRLSCAASGFTFSTYAMNWVRQAPGKGLEWVGRIRSKYNNYATYYADSVKGRFTIS
RDDSKNTLYLQMNSLRAEDTAVYYCVRHGNFGDSYVSWFAYWGQGTLVTVSS/GKPGSGKPGSGKPGSGKPGS/QAV
VTQEPSLTVSPGGTVTLTCGSSTGAVTTSNYANWVQQKPGKSPRGLIGGTNKRAPGVPARFSGSLLGGKAALTISGA
QPEDEADYYCALWYSNHWVFGGGTKLTVL/GGGGSGGGGS/KTHTCPPCPAPPVAGPSVFLPPKPKDTLMISRTPE
VTCVVVDVKHEDPEVKFNWYVDGVEVHNAKTKPREEQYNSTYRVVSVLTVLHQDWLNGKEYKCKVSNKALPAPIEKT
ISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK

*XENP025186 1F10B5[FAP]_L1 Light Chain (SEQ ID NO: 347)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025187 1F4B5[FAP] H1L1 Fab-1F4B5[FAP] H1L1 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025187 1F4B5[FAP]_H1L1_IgG1_PVA_/S267K-pI(-)_Isosteric_A_L368D/K370S Heavy Chain (SEQ ID NO: 348)*

EVQLLESGGGLVQPGGSLRLSCAASGFTFSRYAMTWVRQAPGKGLEWVSSISASGGSTYYADSVKGRFTISRDNSKN
TLYLQMNSLRAEDTAVYYCAKTFSGYAHYDFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025187 1F4B5[FAP]_H1L1_Fab_(G4S)2 (SEQ ID NO: 1174)_[ANTI-CD3]_H1.30_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 349)*

EVQLLESGGGLVQPGGSLRLSCAASGFTFSRYAMTWVRQAPGKGLEWVSSISASGGSTYYADSVKGRFTISRDNSKN
TLYLQMNSLRAEDTAVYYCAKTFSGYAHYDFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKYNNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

FIGURE 21C

*XENP025187 1F4B5[FAP]_L1 Light Chain (SEQ ID NO: 350)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025188 1E5A5(commonLC)[FAP] H1L1 Fab-
1E5A5(commonLC)[FAP] H1L1 Fab (G4S)2 (SEQ ID NO: 1174) [ANTI-
CD3] H1.30 L1.47 scFv(GKPGS)4 (SEQ ID NO: 4) (G4S)2 (SEQ ID NO:
1174) IgG1 PVA /S267K-pI(-) Isosteric A L368D/K370S-IgG1 C220S/S364K/E357Q

*XENP025188 1E5A5(commonLC)[FAP]_H1L1_IgG1_PVA_/S267K-pI(-
)_Isosteric_A_L368D/K370S Heavy Chain (SEQ ID NO: 351)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025188 1E5A5(commonLC)[FAP]_H1L1_Fab_(G4S)2 (SEQ ID NO: 1174)_[ANTI-
CD3]_H1.30_L1.47_scFv(GKPGS)4 (SEQ ID NO: 4)_(G4S)2 (SEQ ID NO:
1174)_IgG1_C220S/S364K/E357Q Fab-scFv-Fc Heavy Chain (SEQ ID NO: 352)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKYNNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025188 1E5A5(commonLC)[FAP]_L1 Light Chain (SEQ ID NO: 353)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025189 1A7B5[FAP] H1L1 Fab-1A7B5[FAP] H1L1 Fab (G4S)2 (SEQ ID NO:
1174) [ANTI-CD3] H1.30 L1.47 scFv(GKPGS)4 (SEQ ID NO: 4) (G4S)2 (SEQ ID NO:
1174) IgG1 PVA /S267K-pI(-) Isosteric A L368D/K370S-IgG1 C220S/S364K/E357Q

FIGURE 21D

*XENP025189 1A7B5[FAP]_H1L1_Fab_IgG1_PVA_/S267K-pI(-)_Isosteric_A_L368D/K370S Fab-Fc Heavy Chain (SEQ ID NO: 354)*

EVQLLESGGGLVQPGGSLRLSCAASGFTFS<u>SYAMS</u>WVRQAPGKGLEWVS<u>GISGGGGSTYYADSVKG</u>RFTISRDNSKN
TLYLQMNSLRAEDTAVYYCAK<u>IAHSRIGWHFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025189 1A7B5[FAP]_H1L1_Fab_(G4S)2 (SEQ ID NO: 1174)_[ANTI-CD3]_H1.30_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 355)*

EVQLLESGGGLVQPGGSLRLSCAASGFTFS<u>SYAMS</u>WVRQAPGKGLEWVS<u>GISGGGGSTYYADSVKG</u>RFTISRDNSKN
TLYLQMNSLRAEDTAVYYCAK<u>IAHSRIGWHFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/<u>GGGGS
GGGGS</u>/EVQLVESGGGLVQPGGSLRLSCAASGFTFS<u>TYAMN</u>WVRQAPGKGLEWVG<u>RIRSKYNNYATYYADSVKG</u>RFT
ISRDDSKNTLYLQMNSLRAEDTAVYYCVRH<u>GNFGDSYVSWFAY</u>WGQGTLVTVSS/<u>GKPGSGKPGSGKPGSGKPGS</u>/Q
AVVTQEPSLTVSPGGTVTLTC<u>GSSTGAVTTSNYAN</u>WVQQKPGKSPRGLIGG<u>TNKRAP</u>GVPARFSGSLLGGKAALTIS
GAQPEDEADYYC<u>ALWYSNHWV</u>FGGGTKLTVL/<u>GGGGSGGGGS</u>/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025189 1A7B5[FAP]_L1 Light Chain (SEQ ID NO: 356)*

DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025191 1F12B5[FAP]_H1L1 Fab-1F12B5[FAP]_H1L1 Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

*XENP025191 1F12B5[FAP]_H1L1_IgG1_PVA_/S267K-pI(-)_Isosteric_A_L368D/K370S Heavy Chain (SEQ ID NO: 357)*

EVQLLESGGGLVQPGGSLRLSCAASGFTFS<u>SYAMT</u>WVRQAPGKGLEWVS<u>TISSSGGTTYYADSVKG</u>RFTISRDNSKN
TLYLQMNSLRAEDTAVYYCAK<u>YPSYYSVTGFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

FIGURE 21E

*XENP025191 1F12B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 358)*

EVQLLESGGGLVQPGGSLRLSCAASGFTFSSYAMTWVRQAPGKGLEWVSTISSSGGTTYYADSVKGRFTISRDNSKN
TLYLQMNSLRAEDTAVYYCAKYPSYYSVTGFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKANNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025191 1F12B5[FAP]_L1 Light Chain (SEQ ID NO: 359)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025192 1F10B5[FAP] H1L1 Fab-1F10B5[FAP] H1L1 Fab (G4S)2 (SEQ ID NO: 1174) [ANTI-CD3] H1.32 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025192 1F10B5[FAP]_H1L1_IgG1_PVA_/S267K-pI(-)_Isosteric_A_L368D/K370S Heavy Chain (SEQ ID NO: 360)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

*XENP025192 1F10B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 361)*

EVQLLESGGGLVQPGGSLRLSCAASGFTFSSYGMSWVRQAPGKGLEWVSGISGSGSSTHYADSVKGRFTISRDNSKN
TLYLQMNSLRAEDTAVYYCAKGTTGLSYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSC/GGGGSGG
GGS/EVQLVESGGGLVQPGGSLRLSCAASGFTFSTYAMNWVRQAPGKGLEWVGRIRSKANNYATYYADSVKGRFTIS
RDDSKNTLYLQMNSLRAEDTAVYYCVRHGNFGDSYVSWFAYWGQGTLVTVSS/GKPGSGKPGSGKPGSGKPGS/QAV
VTQEPSLTVSPGGTVTLTCGSSTGAVTTSNYANWVQQKPGKSPRGLIGGTNKRAPGVPARFSGSLLGGKAALTISGA
QPEDEADYYCALWYSNHWVFGGGTKLTVL/GGGGSGGGGS/KTHTCPPCPAPPVAGPSVFLFPPKPKDTLMISRTPE
VTCVVVDVKHEDPEVKFNWYVDGVEVHNAKTKPREEQYNSTYRVVSVLTVLHQDWLNGKEYKCKVSNKALPAPIEKT
ISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK

FIGURE 21F

*XENP025192 1F10B5[FAP]_L1 Light Chain (SEQ ID NO: 362)*

DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

><u>XENP025193 1F4B5[FAP] H1L1 Fab-1F4B5[FAP] H1L1 Fab (G4S)2 (SEQ ID NO: 1174) [ANTI-CD3] H1.32 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q</u>

*XENP025193 1F4B5[FAP]_H1L1_IgG1_PVA_/S267K-pI(-)_Isosteric_A_L368D/K370S Heavy Chain (SEQ ID NO: 363)*

EVQLLESGGGLVQPGGSLRLSCAASGFTFS<u>RYAMT</u>WVRQAPGKGLEWVS<u>SISASGGSTYYADSVKG</u>RFTISRDNSKN
TLYLQMNSLRAEDTAVYYCAK<u>TFSGYAHYDFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025193 1F4B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 364)*

EVQLLESGGGLVQPGGSLRLSCAASGFTFS<u>RYAMT</u>WVRQAPGKGLEWVS<u>SISASGGSTYYADSVKG</u>RFTISRDNSKN
TLYLQMNSLRAEDTAVYYCAK<u>TFSGYAHYDFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/<u>GGGGS
GGGGS</u>/EVQLVESGGGLVQPGGSLRLSCAASGFTFS<u>TYAMN</u>WVRQAPGKGLEWVG<u>RIRSKANNYATYYADSVKG</u>RFT
ISRDDSKNTLYLQMNSLRAEDTAVYYCVR<u>HGNFGDSYVSWFAY</u>WGQGTLVTVSS/<u>GKPGSGKPGSGKPGSGKPGS</u>/Q
AVVTQEPSLTVSPGGTVTLTC<u>SSTGAVTTSNYAN</u>WVQQKPGKSPRGLIGG<u>TNKRAP</u>GVPARFSGSLLGGKAALTIS
GAQPEDEADYYC<u>ALWYSNHWV</u>FGGGTKLTVL/<u>GGGGSGGGGS</u>/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025193 1F4B5[FAP]_L1 Light Chain (SEQ ID NO: 365)*

DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 21G

>XENP025194 1E5A5(commonLC)[FAP] H1L1 Fab-
1E5A5(commonLC)[FAP] H1L1 Fab (G4S)2 (SEQ ID NO: 1174) [ANTI-
CD3] H1.32 L1.47 scFv(GKPGS)4 (SEQ ID NO: 4) (G4S)2 (SEQ ID NO:
1174) IgG1 PVA /S267K-pI(-) Isosteric A L368D/K370S-IgG1 C220S/S364K/E357Q

*XENP025194 1E5A5(commonLC)[FAP]_H1L1_IgG1_PVA_/S267K-pI(-
)_Isosteric_A_L368D/K370S Heavy Chain (SEQ ID NO: 366)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025194 1E5A5(commonLC)[FAP]_H1L1_Fab_(G4S)2_(SEQ ID NO: 1174)_[ANTI-
CD3]_H1.32_L1.47_scFv(GKPGS)4_(SEQ ID NO: 4)_(G4S)2_(SEQ ID NO:
1174)_IgG1_C220S/S364K/E357Q Fab-scFv-Fc Heavy Chain (SEQ ID NO: 367)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKANNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025194 1E5A5(commonLC)[FAP]_L1 Light Chain (SEQ ID NO: 368)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025195 1A7B5[FAP] H1L1 Fab-1A7B5[FAP] H1L1 Fab (G4S)2 (SEQ ID NO:
1174) [ANTI-CD3] H1.32 L1.47 scFv(GKPGS)4 (SEQ ID NO: 4) (G4S)2 (SEQ ID NO:
1174) IgG1 PVA /S267K-pI(-) Isosteric A L368D/K370S-IgG1 C220S/S364K/E357Q

*XENP025195 1A7B5[FAP]_H1L1_IgG1_PVA_/S267K-pI(-)_Isosteric_A_L368D/K370S
Heavy Chain (SEQ ID NO: 369)*

EVQLLESGGGLVQPGGSLRLSCAASGFTFSSYAMSWVRQAPGKGLEWVSGISGGGGSTYYADSVKGRFTISRDNSKN
TLYLQMNSLRAEDTAVYYCAKIAHSRIGWHFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

FIGURE 21H

*XENP025195 1A7B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 370)*

EVQLLESGGGLVQPGGSLRLSCAASGFTFSSYAMSWVRQAPGKGLEWVSGISGGGGSTYYADSVKGRFTISRDNSKN
TLYLQMNSLRAEDTAVYYCAKIAHSRIGWHFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKANNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025195 1A7B5[FAP]_L1 Light Chain (SEQ ID NO: 371)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSTPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025196 1C3A5[FAP]_H1L1 Fab-1C3A5[FAP]_H1L1 Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1 PVA_/S267K-pI(-)_Isosteric_A_L368D/K370S-IgG1 C220S/S364K/E357Q

*XENP025196 1C3A5[FAP]_H1L1_IgG1_PVA_/S267K-pI(-)_Isosteric_A_L368D/K370S Heavy Chain (SEQ ID NO: 372)*

EVQLLESGGGLVQPGGSLRLSCAASGFTFSSYAMSWVRQAPGKGLEWVSAISGSGGGTRYADSVKGRFTISRDNSKN
TLYLQMNSLRAEDTAVYYCAKHSSGFHWYFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

*XENP025196 1C3A5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 373)*

EVQLLESGGGLVQPGGSLRLSCAASGFTFSSYAMSWVRQAPGKGLEWVSAISGSGGGTRYADSVKGRFTISRDNSKN
TLYLQMNSLRAEDTAVYYCAKHSSGFHWYFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSC/GGGGSG
GGGS/EVQLVESGGGLVQPGGSLRLSCAASGFTFSTYAMNWVRQAPGKGLEWVGRIRSKANNYATYYADSVKGRFTI
SRDDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTISG
AQPEDEADYYCALWYSNHWVFGGGTKLTVL/GGGGSGGGGS/KTHTCPPCPAPPVAGPSVFLFPPKPKDTLMISRTP
EVTCVVVDVKHEDPEVKFNWYVDGVEVHNAKTKPREEQYNSTYRVVSVLTVLHQDWLNGKEYKCKVSNKALPAPIEK
TISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

FIGURE 21I

*XENP025196 1C3A5[FAP]_L1 Light Chain (SEQ ID NO: 374)*

DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSTPRT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP025966 1E5A5[FAP] H1L1 Fab-1E5A5[FAP] H1L1 Fab (G4S)2 (SEQ ID NO: 1174) [ANTI-CD3] H1.30 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025966 1E5A5[FAP]_H1L1_IgG1_PVA_/S267K-pI(-)_Isosteric_A_L368D/K370S Heavy Chain (SEQ ID NO: 375)*

EVQLLESGGGLVQPGGSLRLSCAASGFTFS<u>SYAMS</u>WVRQAPGKGLEWVS<u>GISGSGGSTYYADSVKG</u>RFTISRDNSKN
TLYLQMNSLRAEDTAVYYCAK<u>ISFYPGGTYFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025966 1E5A5[FAP]_H1L1_Fab_(G4S)2 (SEQ ID NO: 1174)_[ANTI-CD3]_H1.30_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 376)*

EVQLLESGGGLVQPGGSLRLSCAASGFTFS<u>SYAMS</u>WVRQAPGKGLEWVS<u>GISGSGGSTYYADSVKG</u>RFTISRDNSKN
TLYLQMNSLRAEDTAVYYCAK<u>ISFYPGGTYFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/<u>GGGGS
GGGGS</u>/EVQLVESGGGLVQPGGSLRLSCAASGFTFS<u>TYAMN</u>WVRQAPGKGLEWVG<u>RIRSKYNNYATYYADSVKG</u>RFT
ISRDDSKNTLYLQMNSLRAEDTAVYYCVR<u>HGNFGDSYVSWFAY</u>WGQGTLVTVSS/<u>GKPGSGKPGSGKPGSGKPGS</u>/Q
AVVTQEPSLTVSPGGTVTLTC<u>GSSTGAVTTSNYAN</u>WVQQKPGKSPRGLIGG<u>TNKRAP</u>GVPARFSGSLLGGKAALTIS
GAQPEDEADYYC<u>ALWYSNHWV</u>FGGGTKLTVL/<u>GGGGSGGGGS</u>/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025966 1E5A5[FAP]_L1 Light Chain (SEQ ID NO: 377)*

DIQMTQSPSSLSASVGDRVTITC<u>RASQSISSYLN</u>WYQQKPGKAPKLLIY<u>AASSLQS</u>GVPSRFSGSGSGTDFTLTISS
LQPEDFATYYC<u>QQSYSSPYT</u>FGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 21J

>XENP025967 1E5A5[FAP] H1L1 Fab-1E5A5[FAP] H1L1 Fab (G4S)2 (SEQ ID NO: 1174) [ANTI-CD3] H1.32 L1.47 scFv(GKPGS)4 (SEQ ID NO: 4) (G4S)2 (SEQ ID NO: 1174) IgG1 PVA /S267K-pI(-) Isosteric A L368D/K370S-IgG1 C220S/S364K/E357Q

*XENP025967 1E5A5[FAP]_H1L1_IgG1_PVA_/S267K-pI(-)_Isosteric_A_L368D/K370S Heavy Chain (SEQ ID NO: 378)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

*XENP025967 1E5A5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q Fab-scFv-Fc Heavy Chain (SEQ ID NO: 379)*

EVQLLESGGGLVQPGGSLRLSCAASGFTFSSYAMSWVRQAPGKGLEWVSGISGSGGSTYYADSVKGRFTISRDNSKN
TLYLQMNSLRAEDTAVYYCAKISFYPGGTYFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSC/GGGGS
GGGGS/EVQLVESGGGLVQPGGSLRLSCAASGFTFSTYAMNWVRQAPGKGLEWVGRIRSKANNYATYYADSVKGRFT
ISRDDSKNTLYLQMNSLRAEDTAVYYCVRHGNFGDSYVSWFAYWGQGTLVTVSS/GKPGSGKPGSGKPGSGKPGS/Q
AVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL/GGGGSGGGGS/KTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIE
KTISKAKGQPREPQVYTLPPSREQMTKNQVKLTCLVKGFYPSDIAVEWESNGQPENNYKTTPPVLDSDGSFFLYSKL
TVDKSRWQQGNVFSCSVMHEALHNHYTQKSLSLSPGK

*XENP025967 1E5A5[FAP]_L1 Light Chain (SEQ ID NO: 380)*

DIQMTQSPSSLSASVGDRVTITCRASQSISSYLNWYQQKPGKAPKLLIYAASSLQSGVPSRFSGSGSGTDFTLTISS
LQPEDFATYYCQQSYSSPYTFGQGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIGURE 22

>sp|P27487|DPP4_HUMAN Dipeptidyl peptidase 4 OS=Homo sapiens GN=DPP4 PE=1 SV=2 (SEQ ID NO: 381)

MKTPWKVLLGLLGAAALVTIITVPVVLLNKGTDDATADSRKTYTLTDYLKNTYRLKLYSLRWISDHEYLYKQENNILVFNA
EYGNSSVFLENSTFDEFGHSINDYSISPDGQFILLEYNYVKQWRHSYTASYDIYDLNKRQLITEERIPNNTQWVTWSPVG
HKLAYVWNNDIYVKIEPNLPSYRITWTGKEDIIYNGITDWVYEEEVFSAYSALWWSPNGTFLAYAQFNDTEVPLIEYSFY
SDESLQYPKTVRVPYPKAGAVNPTVKFFVVNTDSLSSVTNATSIQITAPASMLIGDHYLCDVTWATQERISLQWLRRIQN
YSVMDICDYDESSGRWNCLVARQHIEMSTTGWVGRFRPSEPHFTLDGNSFYKIISNEEGYRHICYFQIDKKDCTFITKGT
WEVIGIEALTSDYLYYISNEYKGMPGGRNLYKIQLSDYTKVTCLSCELNPERCQYYSVSFSKEAKYYQLRCSGPGLPLYTLH
SSVNDKGLRVLEDNSALDKMLQNVQMPSKKLDFIILNETKFWYQMIL

FIGURE 27

| XENP | anti-FAP Clone | Format | Human FAP $K_D$ (M) | Cyno FAP $K_D$ (M) |
|---|---|---|---|---|
| 23930 | 29B11 | bottle-opener | 4.82E-12 | 2.64E-11 |
| 23932 | 29B11 | central-scFv | <1.0E-12 | 2.29E-11 |
| 23934 | 3F2 | bottle-opener | 5.46E-09 | 3.16E-09 |
| 23936 | 3F2 | central-scFv | 3.23E-10 | 1.87E-10 |
| 24011 | sibrotuzumab | central-scFv | 3.08E-11 | 1.49E-11 |

FIGURE 29

|  | 1+1 Fab-scFv-Fc (Bottle-Opener) | | | 2+1 Fab2-scFv-Fc Central-scFv | | |
|---|---|---|---|---|---|---|
| XENP | 23535 | 23536 | 24472 | 24011 | 24473 | 24474 |
| CD3 Affinity | High | High-Int | Intermediate | High | High-Int | Intermediate |
| WI-38 | 0.28 | 0.18 | 0.27 | 0.12 | 0.09 | 0.1 |
| SW-872 | 0.28 | 0.15 | 0.33 | 0.07 | 0.08 | 0.07 |
| HFL-1 | 0.53 | 0.31 | 0.61 | 0.13 | 0.14 | 0.15 |
| Detroit-551 | 0.4 | 0.22 | 0.05 | 0.1 | 0.1 | 0.1 |

FIGURE 33

| XENP | Clone | Human K$_D$ (M) | Cyno K$_D$ (M) | Murine K$_D$ (M) |
|---|---|---|---|---|
| 23534 | sibrotuzumab | <1.0E-12 | <1.0E-12 | No Binding |
| 24454 | 1E5A5 | 3.13E-09 | 3.16E-09 | No Binding |
| 24461 | 1A7B5 | 1.02E-09 | 1.11E-09 | No Binding |
| 24462 | 1F4B5 | 3.72E-10 | 5.30E-10 | 3.30E-08 |
| 24469 | 1D5B5 | 1.19E-09 | 1.12E-09 | No Binding |
| 24471 | 1F10B5 | 9.13E-09 | 6.93E-09 | 4.52E-09 |
| 24460 | 1A1B5 | 5.15E-10 | 4.58E-10 | No Binding |
| 24463 | 1F11B5 | <1.0E-12 | 2.24E-11 | 4.55E-08 |
| 24466 | 1F12B5 | <1.0E-12 | <1.0E-12 | No Binding |
| 24448 | 1C3A5 | 4.54E-09 | 5.01E-09 | No Binding |
| 24444 | 1A4A5 | 2.22E-09 | 4.13E-09 | Weak |

FIGURE 35

| Clone | XENP | sibro 23534 | 3F2 23933 | 1A4A5 24444 | 1C3A5 24448 | 1E5A5 24454 | 1A1B5 24460 | 1A7B5 24461 | 1F4B5 24462 | 1F11B5 24463 | 1F12B5 24466 | 1D5B5 24469 | 1F10B5 24471 | MO36 24860 | FAP5 24861 |
|---|---|---|---|---|---|---|---|---|---|---|---|---|---|---|---|
| sibro | 23534 | 0.0125 | 0.9813 | 0.7112 | 0.6927 | 0.7260 | 0.9673 | 0.8560 | 0.7800 | 0.7595 | 0.7813 | 0.8780 | 0.6178 | 0.8934 | 0.0016 |
| 3F2 | 23933 | 1.0054 | 0.0104 | 0.0548 | 0.0205 | -0.0086 | -0.0017 | -0.0029 | 0.9852 | 0.7927 | 1.0276 | -0.0058 | -0.0454 | 0.0133 | 0.9351 |
| 1A4A5 | 24444 | 0.7836 | 0.3961 | 0.2080 | 0.2089 | 0.2257 | 0.2615 | 0.2728 | 0.3180 | 0.3271 | 0.3352 | 0.3086 | -0.0687 | 0.2724 | 0.8213 |
| 1C3A5 | 24448 | 0.7075 | 0.3705 | 0.1954 | 0.1902 | 0.2170 | 0.2394 | 0.2835 | 0.4023 | 0.6659 | 0.6488 | 0.3034 | -0.1309 | 0.2852 | 0.7679 |
| 1E5A5 | 24454 | 0.7103 | 0.2253 | 0.0493 | 0.0654 | 0.0982 | 0.1249 | 0.1661 | 0.1841 | 0.1691 | 0.1792 | 0.1751 | -0.1998 | 0.1509 | 0.6999 |
| 1A1B5 | 24460 | 0.8765 | 0.0647 | -0.0460 | -0.0416 | -0.0137 | 0.0304 | 0.0250 | 0.0248 | 0.0070 | 0.0077 | 0.0425 | -0.0992 | 0.0195 | 0.8518 |
| 1A7B5 | 24461 | 0.8229 | 0.1088 | -0.0248 | -0.0205 | 0.0071 | 0.0536 | 0.0447 | 0.0742 | 0.0657 | 0.0634 | 0.0724 | -0.1457 | 0.0341 | 0.7737 |
| 1F4B5 | 24462 | 0.7551 | 0.8489 | -0.0555 | 0.0810 | -0.0304 | 0.0384 | 0.0310 | 0.0215 | -0.0803 | 0.0112 | 0.0653 | -0.1168 | 0.0347 | 0.7452 |
| 1F11B5 | 24463 | 0.8087 | 0.7676 | -0.0302 | 0.6617 | -0.0056 | -0.0731 | 0.0474 | 0.0518 | 0.0215 | 0.0324 | 0.0820 | -0.0847 | 0.0585 | 0.8206 |
| 1F12B5 | 24466 | 0.8371 | 0.9514 | -0.0456 | 0.5845 | -0.0119 | 0.0787 | 0.0360 | 0.0360 | 0.0134 | 0.0202 | 0.0688 | -0.0925 | 0.0510 | 0.8104 |
| 1D5B5 | 24469 | 0.8390 | 0.0764 | -0.0439 | -0.0265 | -0.0098 | 0.0311 | 0.0820 | 0.0600 | 0.0417 | 0.0379 | 0.0414 | -0.1425 | 0.0280 | 0.7730 |
| 1F10B5 | 24471 | 0.8910 | 0.6268 | 0.5136 | 0.5076 | 0.4925 | 0.5244 | 0.5224 | 0.5825 | 0.5997 | 0.6129 | 0.5508 | 0.4714 | 0.5459 | 0.9063 |
| MO36 | 24860 | 0.8189 | 0.1107 | -0.0069 | -0.0080 | 0.0193 | 0.0436 | 0.0835 | 0.0969 | 0.0735 | 0.0698 | 0.0868 | -0.1676 | 0.0729 | 0.8006 |
| FAP5 | 24861 | 0.0260 | 0.9769 | 0.7629 | 0.7662 | 0.7633 | 0.9384 | 0.8757 | 0.8299 | 0.7758 | 0.8441 | 0.8994 | 0.6926 | 0.8556 | 0.0086 |
| HB5-EP | | 1 | 1 | 1 | 1 | 1 | 1 | 1 | 1 | 1 | 1 | 1 | 1 | 1 | 1 |

FIGURE 43A

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1A4A5 H1_L1 | A, B, C, D, E. F | A, B, C, D, E. F | A, B, C, D, E. F | A, B, C, D, E. F | A, B, C, D, E. F | A, B, C, D, E. F |
| Anti-FAP 1C3A5 H1_L1 | A, B, C, D, E. F | A, B, C, D, E. F | A, B, C, D, E. F | A, B, C, D, E. F | A, B, C, D, E. F | A, B, C, D, E. F |
| Anti-FAP 1E5A5 H1_L1 | A, B, C, D, E. F | A, B, C, D, E. F | A, B, C, D, E. F | A, B, C, D, E. F | A, B, C, D, E. F | A, B, C, D, E. F |
| Anti-FAP 1E5A5 (common LC) H1_L1 | A, B, C, D, E. F | A, B, C, D, E. F | A, B, C, D, E. F | A, B, C, D, E. F | A, B, C, D, E. F | A, B, C, D, E. F |
| Anti-FAP 1A1B5 H1_L1 | A, B, C, D, E. F | A, B, C, D, E. F | A, B, C, D, E. F | A, B, C, D, E. F | A, B, C, D, E. F | A, B, C, D, E. F |
| Anti-FAP 1A7B5 H1_L1 | A, B, C, D, E. F | A, B, C, D, E. F | A, B, C, D, E. F | A, B, C, D, E. F | A, B, C, D, E. F | A, B, C, D, E. F |

FIGURE 43B

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1F4B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F11B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F12B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1D5B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F10B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP [αFAP]_H0.26_L0 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.11 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.19 | A, B, C, D, E, F | A, B, C, D, E, F | A, B, C, D, E, F | A, B, C, D, E, F | A, B, C, D, E, F | A, B, C, D, E, F |

FIGURE 43C

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1A4A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1C3A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1E5A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1E5A5 (common LC) H1_L1H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1A1B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1A7B5 H1_L1 | A, B, C, D, E, F | A, B, C, D, E, F | A, B, C, D, E, F | A, B, C, D, E, F | A, B, C, D, E, F | A, B, C, D, E, F |

FIGURE 43D

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1F4B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F11B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F12B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1D5B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F10B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP [αFAP]_H0.26_L0 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.11 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.19 | A, B, C, D, E, F | A, B, C, D, E, F | A, B, C, D, E, F | A, B, C, D, E, F | A, B, C, D, E, F | A, B, C, D, E, F |

FIGURE 43E

| | High CD3 | High-Int #1 CD3 | High-Int #2 CD3 | High-Int #3 CD3 | Int. CD3 | Low CD3 |
|---|---|---|---|---|---|---|
| | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1A4A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1C3A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1E5A5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1E5A5 (common LC) H1_L1H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1A1B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1A7B5 H1_L1 | A, B, C, D, E, F | A, B, C, D, E, F | A, B, C, D, E, F | A, B, C, D, E, F | A, B, C, D, E, F | A, B, C, D, E, F |

FIGURE 43F

|  | High CD3 | High-Int #1 CD3 | High-Int #2 CD3 | High-Int #3 CD3 | Int. CD3 | Low CD3 |
|---|---|---|---|---|---|---|
|  | Anti-CD3 H1.30_L1.47 | Anti-CD3 H1.32_L1.47 | Anti-CD3 H1.89_L1.47 | Anti-CD3 H1.90_L1.47 | Anti-CD3 H1.33_L1.47 | Anti-CD3 H1.31_L1.47 |
| Anti-FAP 1F4B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F11B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F12B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1D5B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP 1F10B5 H1_L1 | A, B, C, D, E, F | A, B, C, D, E, F | A, B, C, D, E, F | A, B, C, D, E, F | A, B, C, D, E, F | A, B, C, D, E, F |
| Anti-FAP [αFAP]_H0.26_L0 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.11 | A, B, C, D, E, F | A, B, C, D, E, F | A, B, C, D, E, F | A, B, C, D, E, F | A, B, C, D, E, F | A, B, C, D, E, F |
| Anti-FAP [αFAP]H0.26_L0.19 | A, B, C, D, E, F | A, B, C, D, E, F | A, B, C, D, E, F | A, B, C, D, E, F | A, B, C, D, E, F | A, B, C, D, E, F |

FIGURE 45A

>XENP23533 [aFAP]_H0L0_Fab

Chain 1 - [aFAP]_H0 (SEQ ID NO: 382)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 383)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24774 [aFAP]_H0.1_L0_Fab

Chain 1 - [aFAP]_H0.1 (SEQ ID NO: 384)
QVQLVQSGAEVKKPGASVKVSCKASRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 385)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24775 [aFAP]_H0.2_L0_Fab

Chain 1 - [aFAP]_H0.2 (SEQ ID NO: 386)
QVQLVQSGAEVKKPGASVKVSCKTSGYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 387)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24776 [aFAP]_H0.3_L0_Fab

Chain 1 - [aFAP]_H0.3 (SEQ ID NO: 388)
QVQLVQSGAEVKKPGASVKVSCKASGYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45B

Chain 2 - [aFAP]_L0 (SEQ ID NO: 389)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24777 [aFAP]_H0.4_L0_Fab

Chain 1 - [aFAP]_H0.4 (SEQ ID NO: 390)
QVQLVQSGAEVKKPGASVKVSCKTSRYTFTEYYIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 391)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24778 [aFAP]_H0.5_L0_Fab

Chain 1 - [aFAP]_H0.5 (SEQ ID NO: 392)
QVQLVQSGAEVKKPGASVKVSCKTSRYTFTEYAIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 393)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24779 [aFAP]_H0.6_L0_Fab

Chain 1 - [aFAP]_H0.6 (SEQ ID NO: 394)
QVQLVQSGAEVKKPGASVKVSCKTSRYTFTEYSIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 395)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45C

>XENP24780 [aFAP]_H0.7_L0_Fab

Chain 1 - [aFAP]_H0.7 (SEQ ID NO: 396)
QVQLVQSGAEVKKPGASVKVSCKTSRYTFT<u>EYTMH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 397)
DIVMTQSPDSLAVSLGERATINC<u>KSSQSLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24781 [aFAP]_H0.8_L0_Fab

Chain 1 - [aFAP]_H0.8 (SEQ ID NO: 398)
QVQLVQSGAEVKKPGASVKVSCKTSRYTFT<u>EYTLH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 399)
DIVMTQSPDSLAVSLGERATINC<u>KSSQSLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24782 [aFAP]_H0.9_L0_Fab

Chain 1 - [aFAP]_H0.9 (SEQ ID NO: 472)
QVQLVQSGAEVKKPGASVKVSCKTSRYTFT<u>EYTIH</u>WVRQAPGQRLEWMG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 473)
DIVMTQSPDSLAVSLGERATINC<u>KSSQSLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24783 [aFAP]_H0.10_L0_Fab

Chain 1 - [aFAP]_H0.10 (SEQ ID NO: 474)
QVQLVQSGAEVKKPGASVKVSCKTSRYTFT<u>EYTIH</u>WVRQAPGQRLEWIG<u>WINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45D

Chain 2 - [aFAP]_L0 (SEQ ID NO: 475)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24784 [aFAP]_H0.11_L0_Fab

Chain 1 - [aFAP]_H0.11 (SEQ ID NO: 476)
QVQLVQSGAEVKKPGASVKVSCKTSRYTFTEYTIHWVRQAPGQRLEWIGGINPENGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 477)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24785 [aFAP]_H0.12_L0_Fab

Chain 1 - [aFAP]_H0.12 (SEQ ID NO: 478)
QVQLVQSGAEVKKPGASVKVSCKTSRYTFTEYTIHWVRQAPGQRLEWIGGINPNSGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 479)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24786 [aFAP]_H0.13_L0_Fab

Chain 1 - [aFAP]_H0.13 (SEQ ID NO: 480)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 481)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45E

>XENP24787 [aFAP]_H0.14_L0_Fab

Chain 1 - [aFAP]_H0.14 (SEQ ID NO: 482)
QVQLVQSGAEVKKPGASVKVSCKTSRYTFTEYTIHWVRQAPGQRLEWIGGINPNQGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 483)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24788 [aFAP]_H0.15_L0_Fab

Chain 1 - [aFAP]_H0.15 (SEQ ID NO: 484)
QVQLVQSGAEVKKPGASVKVSCKTSRYTFTEYTIHWVRQAPGQRLEWIGGINPNGGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 485)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24789 [aFAP]_H0.16_L0_Fab

Chain 1 - [aFAP]_H0.16 (SEQ ID NO: 486)
QVQLVQSGAEVKKPGASVKVSCKTSRYTFTEYTIHWVRQAPGQRLEWIGGINPNNSIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 487)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24790 [aFAP]_H0.17_L0_Fab

Chain 1 - [aFAP]_H0.17 (SEQ ID NO: 488)
QVQLVQSGAEVKKPGASVKVSCKTSRYTFTEYTIHWVRQAPGQRLEWIGGINPNGSIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45F

Chain 2 - [aFAP]_L0 (SEQ ID NO: 489)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24791 [aFAP]_H0.18_L0_Fab

Chain 1 - [aFAP]_H0.18 (SEQ ID NO: 490)
QVQLVQSGAEVKKPGASVKVSCKTSRYTFTEYTIHWVRQAPGQRLEWIGGINPNNGITNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 491)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24792 [aFAP]_H0.19_L0_Fab

Chain 1 - [aFAP]_H0.19 (SEQ ID NO: 492)
QVQLVQSGAEVKKPGASVKVSCKTSRYTFTEYTIHWVRQAPGQRLEWIGGINPNNGIPEYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 493)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24793 [aFAP]_H0.20_L0_Fab

Chain 1 - [aFAP]_H0.20 (SEQ ID NO: 494)
QVQLVQSGAEVKKPGASVKVSCKTSRYTFTEYTIHWVRQAPGQRLEWIGGINPNNGIPKYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 495)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45G

>XENP24794 [aFAP]_H0.21_L0_Fab

Chain 1 - [aFAP]_H0.21 (SEQ ID NO: 496)
QVQLVQSGAEVKKPGASVKVSCKTSRYTFTEYTIHWVRQAPGQRLEWIGGINPNNGIPQYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 497)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24795 [aFAP]_H0.22_L0_Fab

Chain 1 - [aFAP]_H0.22 (SEQ ID NO: 498)
QVQLVQSGAEVKKPGASVKVSCKTSRYTFTEYTIHWVRQAPGQRLEWIGGINPNNGIPNYNDKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 499)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24796 [aFAP]_H0.23_L0_Fab

Chain 1 - [aFAP]_H0.23 (SEQ ID NO: 500)
QVQLVQSGAEVKKPGASVKVSCKTSRYTFTEYTIHWVRQAPGQRLEWIGGINPNNGIPNYNQKFQGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 501)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP24801 [aFAP]_H0.24_L0_Fab

Chain 1 - [aFAP]_H0.24 (SEQ ID NO: 502)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCATRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45H

Chain 2 - [aFAP]_L0 (SEQ ID NO: 503)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25264 [aFAP]_H0.25_L0_Fab

Chain 1 - [aFAP]_H0.25 (SEQ ID NO: 504)
QVQLVQSGAEVKKPGASVKVSCKTSRYTFTEYAIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 505)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25265 [aFAP]_H0.26_L0_Fab

Chain 1 - [aFAP]_H0.26 (SEQ ID NO: 506)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0 (SEQ ID NO: 507)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27885 [aFAP]_H0_L0.1_Fab

Chain 1 - [aFAP]_H0 (SEQ ID NO: 508)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.1 (SEQ ID NO: 509)
DIVMTQSPDSLAVSLGERATINCKSSESLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45I

>XENP27886 [aFAP]_H0_L0.2_Fab

Chain 1 - [aFAP]_H0 (SEQ ID NO: 510)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.2 (SEQ ID NO: 511)
DIVMTQSPDSLAVSLGERATINC<u>KSSQTLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27887 [aFAP]_H0_L0.3_Fab

Chain 1 - [aFAP]_H0 (SEQ ID NO: 512)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.3 (SEQ ID NO: 513)
DIVMTQSPDSLAVSLGERATINC<u>KSSQALLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27888 [aFAP]_H0_L0.4_Fab

Chain 1 - [aFAP]_H0 (SEQ ID NO: 514)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.4 (SEQ ID NO: 515)
DIVMTQSPDSLAVSLGERATINC<u>KSSQSVLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27889 [aFAP]_H0_L0.5_Fab

Chain 1 - [aFAP]_H0 (SEQ ID NO: 516)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45J

Chain 2 - [aFAP]_L0.5 (SEQ ID NO: 517)
DIVMTQSPDSLAVSLGERATINCKSSQSILYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27890 [aFAP]_H0_L0.6_Fab

Chain 1 - [aFAP]_H0 (SEQ ID NO: 518)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.6 (SEQ ID NO: 519)
DIVMTQSPDSLAVSLGERATINCKSSQSLVYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27891 [aFAP]_H0_L0.7_Fab

Chain 1 - [aFAP]_H0 (SEQ ID NO: 520)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.7 (SEQ ID NO: 521)
DIVMTQSPDSLAVSLGERATINCKSSQSLIYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27892 [aFAP]_H0_L0.8_Fab

Chain 1 - [aFAP]_H0 (SEQ ID NO: 522)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.8 (SEQ ID NO: 523)
DIVMTQSPDSLAVSLGERATINCKSSQSLLFSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45K

>XENP27893 [aFAP]_H0_L0.9_Fab

Chain 1 - [aFAP]_H0 (SEQ ID NO: 524)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.9 (SEQ ID NO: 525)
DIVMTQSPDSLAVSLGERATINC<u>KSSQSLLYTRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27894 [aFAP]_H0_L0.10_Fab

Chain 1 - [aFAP]_H0 (SEQ ID NO: 526)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.10 (SEQ ID NO: 527)
DIVMTQSPDSLAVSLGERATINC<u>KSSQSLLYARNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27895 [aFAP]_H0_L0.11_Fab

Chain 1 - [aFAP]_H0 (SEQ ID NO: 528)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.11 (SEQ ID NO: 529)
DIVMTQSPDSLAVSLGERATINC<u>KSSQSLLYSSNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27896 [aFAP]_H0_L0.12_Fab

Chain 1 - [aFAP]_H0 (SEQ ID NO: 530)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45L

Chain 2 - [aFAP]_L0.12 (SEQ ID NO: 531)
DIVMTQSPDSLAVSLGERATINCKSSQSLLYSHNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27897 [aFAP]_H0_L0.13_Fab

Chain 1 - [aFAP]_H0 (SEQ ID NO: 532)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.13 (SEQ ID NO: 533)
DIVMTQSPDSLAVSLGERATINCKSSQSLLYSQNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27898 [aFAP]_H0_L0.14_Fab

Chain 1 - [aFAP]_H0 (SEQ ID NO: 534)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.14 (SEQ ID NO: 535)
DIVMTQSPDSLAVSLGERATINCKSSQSLLYSREQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27899 [aFAP]_H0_L0.15_Fab

Chain 1 - [aFAP]_H0 (SEQ ID NO: 536)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.15 (SEQ ID NO: 537)
DIVMTQSPDSLAVSLGERATINCKSSQSLLYSRQQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45M

>XENP27900 [aFAP]_H0_L0.16_Fab

Chain 1 - [aFAP]_H0 (SEQ ID NO: 538)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.16 (SEQ ID NO: 539)
DIVMTQSPDSLAVSLGERATINC<u>KSSQSLLYSRNEKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27901 [aFAP]_H0_L0.17_Fab

Chain 1 - [aFAP]_H0 (SEQ ID NO: 540)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.17 (SEQ ID NO: 541)
DIVMTQSPDSLAVSLGERATINC<u>KSSQSLLYSRNNKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27902 [aFAP]_H0_L0.18_Fab

Chain 1 - [aFAP]_H0 (SEQ ID NO: 542)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.18 (SEQ ID NO: 543)
DIVMTQSPDSLAVSLGERATINC<u>KSSQSLLYSRNQQNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27903 [aFAP]_H0_L0.19_Fab

Chain 1 - [aFAP]_H0 (SEQ ID NO: 544)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45N

Chain 2 - [aFAP]_L0.19 (SEQ ID NO: 545)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27904 [aFAP]_H0_L0.20_Fab

Chain 1 - [aFAP]_H0 (SEQ ID NO: 546)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.20 (SEQ ID NO: 547)
DIVMTQSPDSLAVSLGERATINCKSSQSLLYSRNQKNYLAWYQQKPGQPPRLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27905 [aFAP]_H0_L0.21_Fab

Chain 1 - [aFAP]_H0 (SEQ ID NO: 548)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.21 (SEQ ID NO: 549)
DIVMTQSPDSLAVSLGERATINCKSSQSLLYSRNQKNYLAWYQQKPGQPPQLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27906 [aFAP]_H0_L0.22_Fab

Chain 1 - [aFAP]_H0 (SEQ ID NO: 550)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.22 (SEQ ID NO: 551)
DIVMTQSPDSLAVSLGERATINCKSSQSLLYSRNQKNYLAWYQQKPGQPPELLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45O

>XENP27907 [aFAP]_H0_L0.23_Fab

Chain 1 - [aFAP]_H0 (SEQ ID NO: 552)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCARR<u>RIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.23 (SEQ ID NO: 553)
DIVMTQSPDSLAVSLGERATINC<u>KSSQSLLYSRNQKNYLA</u>WYQQKPGQPPKLLIY<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27908 [aFAP]_H0_L0.24_Fab

Chain 1 - [aFAP]_H0 (SEQ ID NO: 554)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCARR<u>RIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.24 (SEQ ID NO: 555)
DIVMTQSPDSLAVSLGERATINC<u>KSSQSLLYSRNQKNYLA</u>WYQQKPGQPPKLLIF<u>FASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27909 [aFAP]_H0_L0.25_Fab

Chain 1 - [aFAP]_H0 (SEQ ID NO: 556)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCARR<u>RIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.25 (SEQ ID NO: 557)
DIVMTQSPDSLAVSLGERATINC<u>KSSQSLLYSRNQKNYLA</u>WYQQKPGQPPKLLIF<u>YASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27910 [aFAP]_H0_L0.26_Fab

Chain 1 - [aFAP]_H0 (SEQ ID NO: 558)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCARR<u>RIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45P

Chain 2 - [aFAP]_L0.26 (SEQ ID NO: 559)
DIVMTQSPDSLAVSLGERATINCKSSQSLLYSRNQKNYLAWYQQKPGQPPKLLIFWTSTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27911 [aFAP]_H0_L0.27_Fab

Chain 1 - [aFAP]_H0 (SEQ ID NO: 560)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.27 (SEQ ID NO: 561)
DIVMTQSPDSLAVSLGERATINCKSSQSLLYSRNQKNYLAWYQQKPGQPPKLLIFWSSTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27912 [aFAP]_H0_L0.28_Fab

Chain 1 - [aFAP]_H0 (SEQ ID NO: 562)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.28 (SEQ ID NO: 563)
DIVMTQSPDSLAVSLGERATINCKSSQSLLYSRNQKNYLAWYQQKPGQPPKLLIFWATTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27913 [aFAP]_H0_L0.29_Fab

Chain 1 - [aFAP]_H0 (SEQ ID NO: 564)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.29 (SEQ ID NO: 565)
DIVMTQSPDSLAVSLGERATINCKSSQSLLYSRNQKNYLAWYQQKPGQPPKLLIFWAATRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45Q

>XENP27914 [aFAP]_H0_L0.30_Fab

Chain 1 - [aFAP]_H0 (SEQ ID NO: 566)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.30 (SEQ ID NO: 567)
DIVMTQSPDSLAVSLGERATINC<u>KSSQSLLYSRNQKNYLA</u>WYQQKPGQPPKLLIF<u>WASVRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27915 [aFAP]_H0_L0.31_Fab

Chain 1 - [aFAP]_H0 (SEQ ID NO: 568)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.31 (SEQ ID NO: 569)
DIVMTQSPDSLAVSLGERATINC<u>KSSQSLLYSRNQKNYLA</u>WYQQKPGQPPKLLIF<u>WASIRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27916 [aFAP]_H0_L0.32_Fab

Chain 1 - [aFAP]_H0 (SEQ ID NO: 570)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.32 (SEQ ID NO: 571)
DIVMTQSPDSLAVSLGERATINC<u>KSSQSLLYSRNQKNYLA</u>WYQQKPGQPPKLLIF<u>WASLRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27917 [aFAP]_H0_L0.33_Fab

Chain 1 - [aFAP]_H0 (SEQ ID NO: 572)
QVQLVQSGAEVKKPGASVKVSCKTSRYTFT<u>EYTIH</u>WVRQAPGQRLEWIG<u>GINPNNGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45R

Chain 2 - [aFAP]_L0.33 (SEQ ID NO: 573)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27918 [aFAP]_H0_L0.34_Fab

Chain 1 - [aFAP]_H0 (SEQ ID NO: 574)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.34 (SEQ ID NO: 575)
DIVMTQSPDSLAVSLGERATINCKSSQSLLYSRNQKNYLAWYQQKPGQPPKLLIFW/ASTKESGVPDRFSGSGFG
TDFTLTISSLQAEDVAVYYCQQYFSYPLTFGQGTKVEIK/RTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFNRGEC

>XENP27919 [aFAP]_H0_L0.35_Fab

Chain 1 - [aFAP]_H0 (SEQ ID NO: 576)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.35 (SEQ ID NO: 577)
DIVMTQSPDSLAVSLGERATINCKSSQSLLYSRNQKNYLAWYQQKPGQPPKLLIFWASTEESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27920 [aFAP]_H0_L0.36_Fab

Chain 1 - [aFAP]_H0 (SEQ ID NO: 578)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.36 (SEQ ID NO: 579)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYYSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45S

>XENP27921 [aFAP]_H0_L0.37_Fab

Chain 1 - [aFAP]_H0 (SEQ ID NO: 580)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.37 (SEQ ID NO: 581)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFTYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27922 [aFAP]_H0_L0.38_Fab

Chain 1 - [aFAP]_H0 (SEQ ID NO: 582)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.38 (SEQ ID NO: 583)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFAYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27923 [aFAP]_H0_L0.39_Fab

Chain 1 - [aFAP]_H0 (SEQ ID NO: 584)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.39 (SEQ ID NO: 585)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSTPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27924 [aFAP]_H0_L0.40_Fab

Chain 1 - [aFAP]_H0 (SEQ ID NO: 586)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45T

Chain 2 - [aFAP]_L0.40 (SEQ ID NO: 587)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSFPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27925 [aFAP]_H0_L0.41_Fab

Chain 1 - [aFAP]_H0 (SEQ ID NO: 588)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.41 (SEQ ID NO: 589)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSSPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27926 [aFAP]_H0_L0.42_Fab

Chain 1 - [aFAP]_H0 (SEQ ID NO: 590)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.42 (SEQ ID NO: 591)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPITFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27927 [aFAP]_H0_L0.43_Fab

Chain 1 - [aFAP]_H0 (SEQ ID NO: 592)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.43 (SEQ ID NO: 593)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPVTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45U

>XENP27928 [aFAP]_H0_L0.45_Fab

Chain 1 - [aFAP]_H0 (SEQ ID NO: 594)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.45 (SEQ ID NO: 595)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLVFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27929 [aFAP]_H0_L1(CLC)_Fab

Chain 1 - [aFAP]_H0 (SEQ ID NO: 596)
QVQLVQSGAEVKKPGASVKVSCKTSRYTFTEYTIHWVRQAPGQRLEWIGGINPNNGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L1(CLC) (SEQ ID NO: 597)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP27964 [aFAP]_H0.13_L0.11_Fab

Chain 1 - [aFAP]_H0.13 (SEQ ID NO: 598)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.11 (SEQ ID NO: 599)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27965 [aFAP]_H0.13_L0.14_Fab

Chain 1 - [aFAP]_H0.13 (SEQ ID NO: 600)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

FIGURE 45V

Chain 2 - [aFAP]_L0.14 (SEQ ID NO: 601)
DIVMTQSPDSLAVSLGERATINCKSSQSLLYSREQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27966 [aFAP]_H0.13_L0.19_Fab

Chain 1 - [aFAP]_H0.13 (SEQ ID NO: 602)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.19 (SEQ ID NO: 603)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27967 [aFAP]_H0.13_L0.41_Fab

Chain 1 - [aFAP]_H0.13 (SEQ ID NO: 604)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.41 (SEQ ID NO: 605)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSSPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27968 [aFAP]_H0.26_L0.11_Fab

Chain 1 - [aFAP]_H0.26 (SEQ ID NO: 606)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.11 (SEQ ID NO: 607)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 45W

>XENP27969 [aFAP] H0.26_L0.14_Fab

Chain 1 - [aFAP]_H0.26 (SEQ ID NO: 608)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.14 (SEQ ID NO: 609)
DIVMTQSPDSLAVSLGERATINCKSSQSLLYSREQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27970 [aFAP] H0.26_L0.19_Fab

Chain 1 - [aFAP]_H0.26 (SEQ ID NO: 610)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.19 (SEQ ID NO: 611)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP27971 [aFAP] H0.26_L0.41_Fab

Chain 1 - [aFAP]_H0.26 (SEQ ID NO: 612)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSCGS

Chain 2 - [aFAP]_L0.41 (SEQ ID NO: 613)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSSPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 46

XENP22476_His-Avi_hFc-Tev-huFAP (SEQ ID NO: 614)

HHHHHHGGGGSGLNDIFEAQKIEWHEGGSEPKSSDKTHTCPPCPAPELLGGPSVFLFPPKPKDTLMISRTPEVTCV
VVDVSHEDPEVKFNWYVDGVEVHNAKTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGKGGSENLYFQGGGGGSIVLRPSRVHNSEENTMRALTLKDILN
GTFSYKTFFPNWISGQEYLHQSADNNIVLYNIETGQSYTILSNRTMKSVNASNYGLSPDRQFVYLESDYSKLWRYSY
TATYYIYDLSNGEFVRGNELPRPIQYLCWSPVGSKLAYVYQNNIYLKQRPGDPPFQITFNGRENKIFNGIPDWVYEE
EMLATKYALWWSPNGKFLAYAEFNDTDIPVIAYSYYGDEQYPRTINIPYPKAGAKNPVVRIFIIDTTYPAYVGPQEVP
VPAMIASSDYYFSWLTWVTDERVCLQWLKRVQNVSVLSICDFREDWQTWDCPKTQEHIEESRTGWAGGFFVSTP
VFSYDAISYYKIFSDKDGYKHIHYIKDTVENAIQITSGKWEAINIFRVTQDSLFYSSNEFEEYPGRRNIYRISIGSYPPSKK
CVTCHLRKERCQYYTASFSDYAKYYALVCYGPGIPISTLHDGRTDQEIKILEENKELENALKNIQLPKEEIKKLEVDEITL
WYKMILPPQFDRSKKYPLLIQVYGGPCSQSVRSVFAVNWISYLASKEGMVIALVDGRGTAFQGDKLLYAVYRKLGV
YEVEDQITAVRKFIEMGFIDEKRIAIWGWSYGGYVSSLALASGTGLFKCGIAVAPVSSWEYYASVYTERFMGLPTKD
DNLEHYKNSTVMARAEYFRNVDYLLIHGTADDNVHFQNSAQIAKALVNAQVDFQAMWYSDQNHGLSGLSTNHL
YTHMTHFLKQCFSLSD

FIGURE 47

| XENP | $K_D$ (M) | $k_a$ (1/Ms) | $k_d$ (1/s) |
|---|---|---|---|
| 23533 | 4.20E-10 | 6.73E+05 | 2.83E-04 |
| 24774 | 3.24E-10 | 7.80E+05 | 2.53E-04 |
| 24775 | 6.88E-10 | 8.53E+05 | 5.87E-04 |
| 24776 | 6.08E-10 | 6.69E+05 | 4.07E-04 |
| 24777 | N/A | N/A | N/A |
| 24778 | 4.35E-08 | 6.99E+05 | 3.04E-02 |
| 24779 | 8.06E-09 | 8.55E+05 | 6.88E-03 |
| 24780 | 6.18E-10 | 7.07E+05 | 4.37E-04 |
| 24781 | 5.22E-10 | 6.87E+05 | 3.59E-04 |
| 24782 | 3.42E-10 | 7.98E+05 | 2.73E-04 |
| 24783 | N/A | N/A | N/A |
| 24784 | 3.74E-09 | 4.91E+05 | 1.83E-03 |
| 24785 | 6.07E-09 | 6.56E+05 | 3.98E-03 |
| 24786 | 4.48E-09 | 7.60E+05 | 3.40E-03 |
| 24787 | 7.24E-09 | 6.07E+05 | 4.40E-03 |
| 24788 | 4.56E-09 | 5.89E+05 | 2.69E-03 |
| 24789 | 4.39E-09 | 2.78E+05 | 1.22E-03 |
| 24790 | 1.68E-08 | 6.15E+05 | 1.04E-02 |
| 24791 | N/A | N/A | N/A |
| 24792 | N/A | N/A | N/A |
| 24793 | N/A | N/A | N/A |
| 24794 | N/A | N/A | N/A |
| 24795 | 2.29E-10 | 6.21E+05 | 1.42E-04 |
| 24796 | 4.38E-10 | 5.54E+05 | 2.42E-04 |
| 24801 | 1.70E-09 | 7.98E+05 | 1.36E-03 |

FIGURE 48

| XENP | $K_D$ (M) | $k_a$ (1/Ms) | $k_d$ (1/s) |
|------|-----------|--------------|-------------|
| 23533 | 1.85E-10 | 6.34E+05 | 1.17E-04 |
| 25264 | 4.1-5.7E-07 | | |
| 25265 | 3.65E-08 | 8.81E+05 | 3.22E-02 |

FIGURE 49A

| Sample ID | $K_D$ (M) | $k_a$ (1/Ms) | $k_d$ (1/s) |
|---|---|---|---|
| 23533 | 8.18E-10 | 9.95E+05 | 8.14E-04 |
| 27885 | 8.65E-10 | 9.80E+05 | 8.48E-04 |
| 27886 | 9.31E-10 | 9.78E+05 | 9.11E-04 |
| 27887 | 1.01E-09 | 8.28E+05 | 8.32E-04 |
| 27888 | 6.87E-10 | 1.01E+06 | 6.95E-04 |
| 27889 | 9.75E-10 | 8.92E+05 | 8.69E-04 |
| 27890 | 3.61E-10 | 7.47E+05 | 2.69E-04 |
| 27891 | 7.32E-10 | 6.08E+05 | 4.45E-04 |
| 27892 | 1.48E-09 | 6.32E+05 | 9.34E-04 |
| 27893 | 9.89E-10 | 8.50E+05 | 8.41E-04 |
| 27894 | 1.07E-09 | 8.22E+05 | 8.79E-04 |
| 27895 | 2.38E-09 | 9.01E+05 | 2.15E-03 |
| 27896 | 1.66E-09 | 9.48E+05 | 1.57E-03 |
| 27897 | 1.51E-09 | 8.68E+05 | 1.31E-03 |
| 27898 | 3.87E-08 | 7.88E+05 | 3.05E-02 |
| 27899 | 2.43E-09 | 1.09E+06 | 2.65E-03 |
| 27900 | 9.88E-10 | 8.55E+05 | 8.45E-04 |
| 27901 | 4.78E-10 | 9.36E+05 | 4.47E-04 |
| 27902 | 6.60E-10 | 9.00E+05 | 5.93E-04 |
| 27903 | 1.05E-09 | 5.75E+05 | 6.04E-04 |
| 27904 | 7.35E-10 | 9.01E+05 | 6.62E-04 |
| 27905 | 8.16E-10 | 9.98E+05 | 8.14E-04 |

FIGURE 49B

| Sample ID | $K_D$ (M) | $k_a$ (1/Ms) | $k_d$ (1/s) |
|---|---|---|---|
| 27906 | 1.00E-09 | 8.96E+05 | 8.98E-04 |
| 27907 | 7.17E-10 | 1.04E+06 | 7.47E-04 |
| 27908 | 5.32E-10 | 7.84E+05 | 4.17E-04 |
| 27909 | 1.42E-09 | 9.42E+05 | 1.34E-03 |
| 27910 | 3.63E-10 | 9.15E+05 | 3.32E-04 |
| 27911 | 4.11E-10 | 1.09E+06 | 4.46E-04 |
| 27912 | 6.99E-10 | 8.81E+05 | 6.16E-04 |
| 27913 | 9.44E-10 | 7.73E+05 | 7.29E-04 |
| 27914 | 3.87E-10 | 9.18E+05 | 3.55E-04 |
| 27915 | 2.55E-10 | 1.14E+06 | 2.89E-04 |
| 27916 | 3.56E-10 | 9.58E+05 | 3.41E-04 |
| 27917 | 1.07E-09 | 9.32E+05 | 9.97E-04 |
| 27918 | 1.22E-09 | 7.77E+05 | 9.49E-04 |
| 27919 | 9.92E-10 | 8.50E+05 | 8.43E-04 |
| 27920 | 9.61E-10 | 8.64E+05 | 8.30E-04 |
| 27921 | 1.04E-09 | 9.22E+05 | 9.55E-04 |
| 27922 | 1.34E-09 | 1.16E+06 | 1.55E-03 |
| 27923 | 2.11E-09 | 8.71E+05 | 1.84E-03 |
| 27924 | 3.43E-09 | 1.67E+06 | 5.73E-03 |
| 27925 | 5.28E-09 | 8.71E+05 | 4.60E-03 |
| 27926 | 5.31E-10 | 9.95E+05 | 5.28E-04 |
| 27927 | 5.32E-10 | 1.15E+06 | 6.12E-04 |
| 27928 | 2.46E-10 | 8.54E+05 | 2.11E-04 |
| 27929 | 1.30E-07 | 1.19E+06 | 1.55E-01 |

FIGURE 50

| Sample ID | $K_D$ (M) | $k_a$ (1/Ms) | $k_d$ (1/s) |
|---|---|---|---|
| 23533 | 7.25E-10 | 7.62E+05 | 5.53E-04 |
| 24779 | 8.03E-09 | 1.50E+06 | 1.20E-02 |
| 24801 | 1.24E-09 | 2.39E+06 | 2.96E-03 |
| 25265 | 1.83E-09 | 2.71E+06 | 4.95E-03 |
| 27964 | 2.60E-08 | 5.62E+05 | 1.46E-02 |
| 27965 | 3.78E-07 | 5.30E+05 | 2.00E-01 |
| 27966 | 1.30E-08 | 4.18E+05 | 5.43E-03 |
| 27967 | 5.33E-08 | 5.12E+05 | 2.73E-02 |
| 27968 | 3.11E-07 | 1.02E+06 | 3.15E-01 |
| 27969 | N/A | N/A | N/A |
| 27970 | 1.34E-07 | 7.74E+05 | 1.04E-01 |
| 27971 | 3.88E-07 | 7.40E+05 | 2.87E-01 |

FIGURE 51A

>XENP25388 [aFAP]_H0.13_L0_Fab-[aFAP]_H0.13_L0_Fab_(G4S)2 (SEQ ID NO:
1174)_[aCD3]_H1.30_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Monomer 1 - [aFAP]_H0.13_IgG1_PVA_/S267K-pI(-)_Isosteric_A_L368D/K370S (SEQ ID NO: 615)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.13_[aCD3]_H1.30_L1.47_scFv(GKPGS)4 (SEQ ID NO: 4)_(G4S)2 (SEQ ID NO: 1174)_IgG1_C220S/S364K/E357Q (SEQ ID NO: 616)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKYNNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0 (SEQ ID NO: 617)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC >XENP25389 [aFAP]_H0.25_L0_Fab-[aFAP]_H0.25_L0_Fab_(G4S)2 (SEQ ID NO:
1174)_[aCD3]_H1.30_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Monomer 1 - Chain 1 - [aFAP]_H0.25_IgG1_PVA_/S267K-pI(-)_Isosteric_A_L368D/K370S (SEQ ID NO: 618)
QVQLVQSGAEVKKPGASVKVSCKTSRYTFTEYAIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 51B

Monomer 2 - [aFAP]_H0.25_[aCD3]_H1.30_L1.47_scFv(GKPGS)4 (SEQ ID NO: 4)_(G4S)2 (SEQ ID NO: 1174)_IgG1_C220S/S364K/E357Q (SEQ ID NO: 619)

QVQLVQSGAEVKKPGASVKVSCKTSRYTFTEYAIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKYNNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0 (SEQ ID NO: 620)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25390 [aFAP]_H0.26_L0_Fab-[aFAP]_H0.26_L0_Fab_(G4S)2 (SEQ ID NO: 1174)_[aCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Monomer 1 - [aFAP]_H0.26_IgG1_PVA_/S267K-pI(-)_Isosteric_A_L368D/K370S (SEQ ID NO: 621)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.26_[aCD3]_H1.30_L1.47_scFv(GKPGS)4 (SEQ ID NO: 4)_(G4S)2 (SEQ ID NO: 1174)_IgG1_C220S/S364K/E357Q (SEQ ID NO: 622)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKYNNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

FIGURE 51C

Monomer 3 - [aFAP]_L0 (SEQ ID NO: 623)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25391 [aFAP]_H0.13_L0_Fab-[aFAP]_H0.13_L0_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Monomer 1 - [aFAP]_H0.13_IgG1_PVA_/S267K-pI(-)_Isosteric_A_L368D/K370S (SEQ ID NO: 624)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.13_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 625)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0 (SEQ ID NO: 626)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25392 [aFAP]_H0.25_L0_Fab-[aFAP]_H0.25_L0_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Monomer 1 - [aFAP]_H0.25_IgG1_PVA_/S267K-pI(-)_Isosteric_A_L368D/K370S (SEQ ID NO: 627)
QVQLVQSGAEVKKPGASVKVSCKTSRYTFTEYAIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 51D

Monomer 2 - [aFAP]_H0.25_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 628)

QVQLVQSGAEVKKPGASVKVSCKTSRYTFTEYAIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0 (SEQ ID NO: 629)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25393 [aFAP]_H0.26_L0_Fab-[aFAP]_H0.26_L0_Fab_(G4S) (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Monomer 1 - [aFAP]_H0.26_IgG1_PVA_/S267K-pI(-)_Isosteric_A_L368D/K370S (SEQ ID NO: 630)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 631)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0 (SEQ ID NO: 632)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 51E

>XENP28114 [aFAP] H0.13_L0.19_Fab-[aFAP]_H0.13_L0.19_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S-IgG1_C220S/S364K/E357Q

Monomer 1 - [aFAP]_H0.13_IgG1_PVA_/S267K_pI(-)_Isosteric_A_L368D/K370S (SEQ ID NO: 633)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.13_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 634)
QVQLVQSGAEVKKPGASVKVSCKTSRYTFTEYTIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0.19 (SEQ ID NO: 635)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC >XENP28115 [aFAP] H0.26_L0.19_Fab-[aFAP]_H0.26_L0.19_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S-IgG1_C220S/S364K/E357Q

Monomer 1 - [aFAP]_H0.26_IgG1_PVA_/S267K_pI(-)_Isosteric_A_L368D/K370S (SEQ ID NO: 636)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 51F

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 637)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0.19 (SEQ ID NO: 638)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP28116 [aFAP]_H0.26_L0.11_Fab-[aFAP]_H0.26_L0.11_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S-IgG1_C220S/S364K/E357Q

Monomer 1 - [aFAP]_H0.26_IgG1_PVA_/S267K_pI(-)_Isosteric_A_L368D/K370S (SEQ ID NO: 639)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q (SEQ ID NO: 640)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0.11 (SEQ ID NO: 641)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 51G

<u>>XENP28117 [aFAP]_H0.26_L0.19_Fab-[aFAP]_H0.26_L0.19_Fab_(G4S)2 (SEQ ID NO: 1174)_[aCD3]_H1.30_L1.47_scFv(GKPGS)4 (SEQ ID NO: 4)_(G4S)2 (SEQ ID NO: 1174)_IgG1_PVA_/S267K_pI(-)_Isosteric_A_L368D/K370S-IgG1_C220S/S364K/E357Q</u>

Monomer 1 - [aFAP]_H0.26_IgG1_PVA_/S267K_pI(-)_Isosteric_A_L368D/K370S (SEQ ID NO: 642)
QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.26_[aCD3]_H1.30_L1.47_scFv(GKPGS)4 (SEQ ID NO: 4)_(G4S)2 (SEQ ID NO: 1174)_IgG1_C220S/S364K/E357Q (SEQ ID NO: 643)
QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/<u>GGGGSGGGGS</u>/EVQLVESGGGLVQPGGSLRLSCAASGFTFS<u>TYAMN</u>WVRQAPGKGLEWVG<u>RIRSKYNNYAT
YYADSVKG</u>RFTISRDDSKNTLYLQMNSLRAEDTAVYYCVR<u>HGNFGDSYVSWFAY</u>WGQGTLVTVSS/<u>GKPGSGKPG
SGKPGSGKPGS</u>/QAVVTQEPSLTVSPGGTVTLTC<u>GSSTGAVTTSNYAN</u>WVQQKPGKSPRGLIG<u>GTNKRAP</u>GVPAR
FSGSLLGGKAALTISGAQPEDEADYYC<u>ALWYSNHWV</u>FGGGTKLTVL/<u>GGGGSGGGGS</u>/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0.19 (SEQ ID NO: 644)
DIVMTQSPDSLAVSLGERATINC<u>KSSQSLLYSRNQENYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 51H

>XENP28118_[aFAP]_H0.26_L0.11_Fab-[aFAP]_H0.26_L0.11_Fab_(G4S)2 (SEQ ID NO: 1174)_[aCD3]_H1.30_L1.47_scFv(GKPGS)4 (SEQ ID NO: 4)_(G4S)2 (SEQ ID NO: 1174)_IgG1_PVA_/S267K_pI(-)_Isosteric_A_L368D/K370S-IgG1_C220S/S364K/E357Q

Monomer 1 - [aFAP]_H0.26_IgG1_PVA_/S267K_pI(-)_Isosteric_A_L368D/K370S (SEQ ID NO: 645)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Monomer 2 - [aFAP]_H0.26_[aCD3]_H1.30_L1.47_scFv(GKPGS)4 (SEQ ID NO: 4)_(G4S)2 (SEQ ID NO: 1174)_IgG1_C220S/S364K/E357Q (SEQ ID NO: 646)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKYNNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Monomer 3 - [aFAP]_L0.11 (SEQ ID NO: 647)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

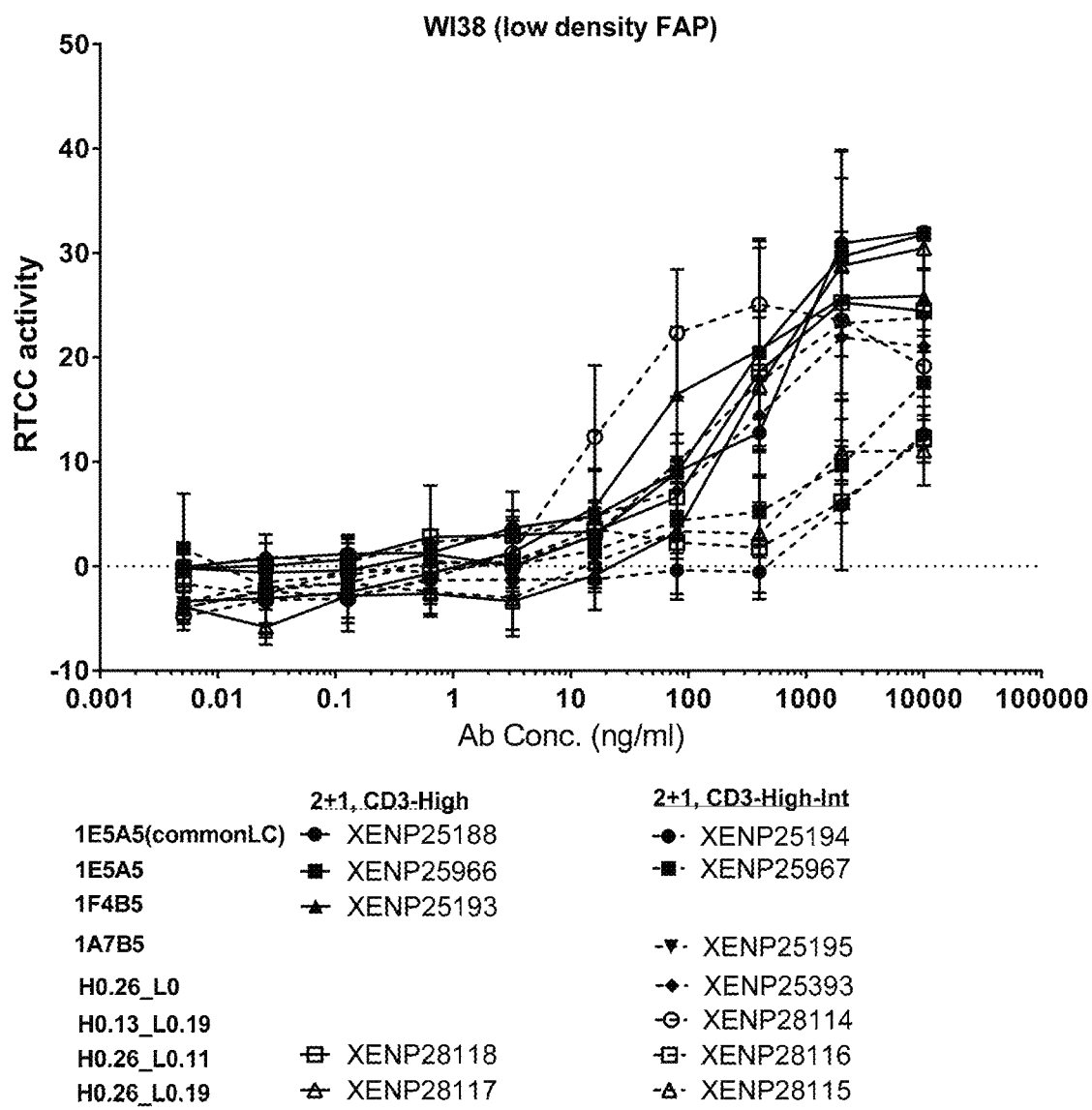

FIGURE 53
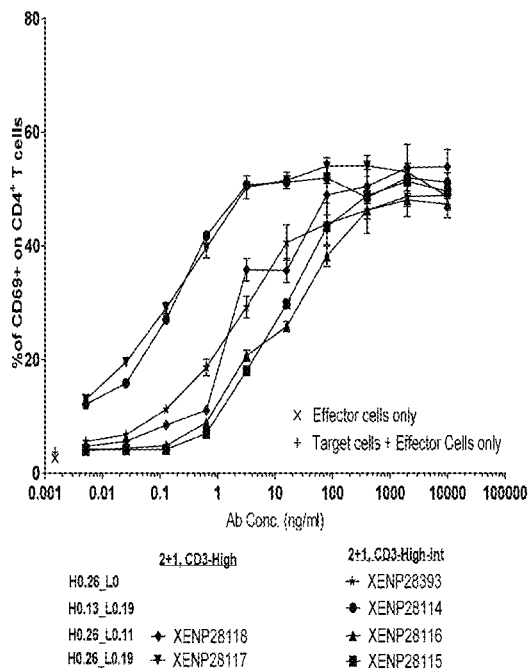
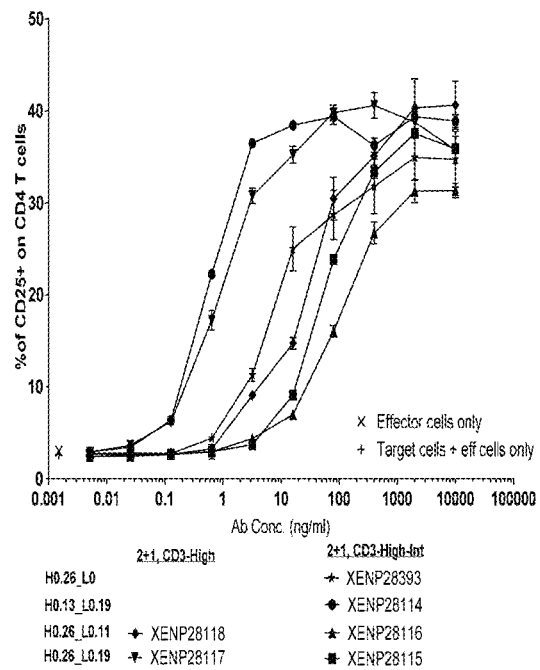
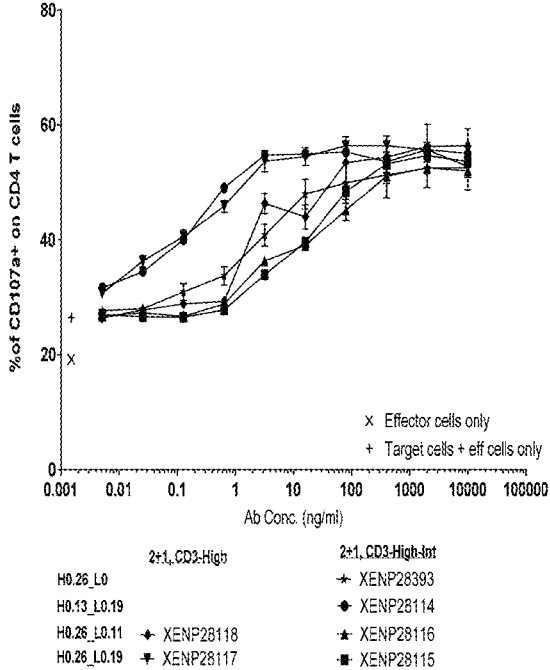

FIGURE 58

XENP24370_huFAP_6xLys_6xHis (SEQ ID NO: 648 and "6xHis" disclosed as SEQ ID NO: 1175)

RPSRVHNSEENTMRALTLKDILNGTFSYKTFFPNWISGQEYLHQSADNNIVLYNIETGQSYTILSNRT
MKSVNASNYGLSPDRQFVYLESDYSKLWRYSYTATYYIYDLSNGEFVRGNELPRPIQYLCWSPVGSKL
AYVYQNNIYLKQRPGDPPFQITFNGRENKIFNGIPDWVYEEEMLATKYALWWSPNGKFLAYAEFNDTD
IPVIAYSYYGDEQYPRTINIPYPKAGAKNPVVRIFIIDTTYPAYVGPQEVPVPAMIASSDYYFSWLTW
VTDERVCLQWLKRVQNVSVLSICDFREDWQTWDCPKTQEHIEESRTGWAGGFFVSTPVFSYDAISYYK
IFSDKDGYKHIHYIKDTVENAIQITSGKWEAINIFRVTQDSLFYSSNEFEEYPGRRNIYRISIGSYPP
SKKCVTCHLRKERCQYYTASFSDYAKYYALVCYGPGIPISTLHDGRTDQEIKILEENKELENALKNIQ
LPKEEIKKLEVDEITLWYKMILPPQFDRSKKYPLLIQVYGGPCSQSVRSVFAVNWISYLASKEGMVIA
LVDGRGTAFQGDKLLYAVYRKLGVYEVEDQITAVRKFIEMGFIDEKRIAIWGWSYGGYVSSLALASGT
GLFKCGIAVAPVSSWEYYASVYTERFMGLPTKDDNLEHYKNSTVMARAEYFRNVDYLLIHGTADDNVH
FQNSAQIAKALVNAQVDFQAMWYSDQNHGLSGLSTNHLYTHMTHFLKQCFSLSDGSKKKKKKGSHHHH
HH

FIGURE 62A

>XENP29140_[aFAP]_H0.26_L0_Fab-[aFAP]_H0.26_L0_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S/M428L/N434S-IgG1_C220S/S364K/E357Q/M428L/N434S

Monomer 1 - [aFAP]_H0.26_IgG1_PVA_/S267K_pI(-)_Isosteric_A_L368D/K370S/M428L/N434S (SEQ ID NO: 649)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q/M428L/N434S (SEQ ID NO: 650)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVLHEALHSHYTQKSLSLSPGK

Monomer 3 - [aFAP]_L0 (SEQ ID NO: 651)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC >XENP29141_[aFAP]_H0.26_L0.19_Fab-[aFAP]_H0.26_L0.19_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S/M428L/N434S-IgG1_C220S/S364K/E357Q/M428L/N434S

Monomer 1 - [aFAP]_H0.26_IgG1_PVA_/S267K_pI(-)_Isosteric_A_L368D/K370S/M428L/N434S (SEQ ID NO: 652)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 62B

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q/M428L/N434S (SEQ ID NO: 653)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVLHEALHSHYTQKSLSLSPGK

Monomer 3 - [aFAP]_L0.19 (SEQ ID NO: 654)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP29142 [aFAP]_H0.26_L0.11_Fab-[aFAP]_H0.26_L0.11_Fab_(G4S)2 (SEQ ID NO: 1174)_[aCD3]_H1.32_L1.47_scFv(GKPGS)4 (SEQ ID NO: 4)_(G4S)2 (SEQ ID NO: 1174)_IgG1_PVA_/S267K_pI(-)_Isosteric_A_L368D/K370S/M428L/N434S-IgG1_C220S/S364K/E357Q/M428L/N434S

Monomer 1 - [aFAP]_H0.26_IgG1_PVA_/S267K_pI(-)_Isosteric_A_L368D/K370S/M428L/N434S (SEQ ID NO: 655)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Monomer 2 - [aFAP]_H0.26_[aCD3]_H1.32_L1.47_scFv(GKPGS)4 (SEQ ID NO: 4)_(G4S)2 (SEQ ID NO: 1174)_IgG1_C220S/S364K/E357Q/M428L/N434S (SEQ ID NO: 656)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDKKVEP
KSC/GGGGSGGGGS/EVQLVESGGGLVQPGGSLRLSCAASGFTFSTYAMNWVRQAPGKGLEWVGRIRSKANNYAT
YYADSVKGRFTISRDDSKNTLYLQMNSLRAEDTAVYYCVRHGNFGDSYVSWFAYWGQGTLVTVSS/GKPGSGKPG
SGKPGSGKPGS/QAVVTQEPSLTVSPGGTVTLTCGSSTGAVTTSNYANWVQQKPGKSPRGLIGGTNKRAPGVPAR
FSGSLLGGKAALTISGAQPEDEADYYCALWYSNHWVFGGGTKLTVL/GGGGSGGGGS/KTHTCPPCPAPPVAGPS
VFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVLHEALHSHYTQKSLSLSPGK

FIGURE 62C

Monomer 3 - [aFAP]_L0.11 (SEQ ID NO: 657)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

> >XENC1000 1F4B5[FAP]_H1L1_Fab-1F4B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Monomer 1 – 1F4B5[FAP]_H1L1_IgG1_PVA_/S267K-pI(-)_Isosteric_A_L368D/K370S/M428L/N434S Heavy Chain (SEQ ID NO: 658)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Monomer 2 - 1F4B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q/M428L/N434S Fab-scFv-Fc Heavy Chain (SEQ ID NO: 659)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
/GGGGSGGGGS/EVQLVESGGGLVQPGGSLRLSCAASGFTFSTYAMNWVRQAPGKGLEWVGRIRSKANNYATYYA
DSVKGRFTISRDDSKNTLYLQMNSLRAEDTAVYYCVRHGNFGDSYVSWFAYWGQGTLVTVSS/GKPGSGKPGSGK
PGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/GGGGSGGGGS/KTHTCPPCPAPPVAGPSVFL
FPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Monomer 3 - 1F4B5[FAP]_L1 Light Chain (SEQ ID NO: 660)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

> XENC1001 1E5A5(commonLC)[FAP]_H1L1_Fab-1E5A5(commonLC)[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Monomer 1 - 1E5A5(commonLC)[FAP]_H1L1_IgG1_PVA_/S267K-pI(-)_Isosteric_A_L368D/K370S/M428L/N434S Heavy Chain (SEQ ID NO: 661)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 62D

Monomer 2 - 1E5A5(commonLC)[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q/M428L/N434S Fab-scFv-Fc Heavy Chain (SEQ ID NO: 662)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
/GGGGSGGGGS/EVQLVESGGGLVQPGGSLRLSCAASGFTFSTYAMNWVRQAPGKGLEWVGRIRSKANNYATYYA
DSVKGRFTISRDDSKNTLYLQMNSLRAEDTAVYYCVRHGNFGDSYVSWFAYWGQGTLVTVSS/GKPGSGKPGSGK
PGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/GGGGSGGGGS/KTHTCPPCPAPPVAGPSVFL
FPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Monomer 3 - 1E5A5(commonLC)[FAP]_L1 Light Chain (SEQ ID NO: 663)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

> XENC1002 1A7B5[FAP]_H1L1_Fab-1A7B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Monomer 1 - 1A7B5[FAP]_H1L1_IgG1_PVA_/S267K-pI(-)_Isosteric_A_L368D/K370S/M428L/N434S Heavy Chain (SEQ ID NO: 664)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Monomer 2 - 1A7B5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q/M428L/N434S Fab-scFv-Fc Heavy Chain (SEQ ID NO: 665)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
/GGGGSGGGGS/EVQLVESGGGLVQPGGSLRLSCAASGFTFSTYAMNWVRQAPGKGLEWVGRIRSKANNYATYYA
DSVKGRFTISRDDSKNTLYLQMNSLRAEDTAVYYCVRHGNFGDSYVSWFAYWGQGTLVTVSS/GKPGSGKPGSGK
PGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/GGGGSGGGGS/KTHTCPPCPAPPVAGPSVFL
FPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Monomer 3 - 1A7B5[FAP]_L1 Light Chain (SEQ ID NO: 666)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 62E

> XENC1004 1E5A5[FAP]_H1L1_Fab-1E5A5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Monomer 1 - 1E5A5[FAP]_H1L1_IgG1_PVA_/S267K-pI(-)_Isosteric_A_L368D/K370S/M428L/N434S Heavy Chain (SEQ ID NO: 667)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Monomer 2 - 1E5A5[FAP]_H1L1_Fab_(G4S)2 (SEQ ID NO: 1174)_[ANTI-CD3]_H1.32_L1.47_scFv(GKPGS)4 (SEQ ID NO: 4)_(G4S)2 (SEQ ID NO: 1174)_IgG1_C220S/S364K/E357Q/M428L/N434S Fab-scFv-Fc Heavy Chain (SEQ ID NO: 668)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
/GGGGSGGGGS/EVQLVESGGGLVQPGGSLRLSCAASGFTFSTYAMNWVRQAPGKGLEWVGRIRSKANNYATYYA
DSVKGRFTISRDDSKNTLYLQMNSLRAEDTAVYYCVRHGNFGDSYVSWFAYWGQGTLVTVSS/GKPGSGKPGSGK
PGSGKPGS/QAVVTQEPSLTVSPGGTVTLTCGSSTGAVTTSNYANWVQQKPGKSPRGLIGGTNKRAPGVPARFSG
SLLGGKAALTISGAQPEDEADYYCALWYSNHWVFGGGTKLTVL/GGGGSGGGGS/KTHTCPPCPAPPVAGPSVFL
FPPKPKDTLMISRTPEVTCVVVDVKHEDPEVKFNWYVDGVEVHNAKTKPREEQYNSTYRVVSVLTVLHQDWLNGK
EYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Monomer 3 - 1E5A5[FAP]_L1 Light Chain (SEQ ID NO: 669)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 63A

2+1 - H1.30_L1.47 - no Xtend
Chain 1 SEQ ID NO:400
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:401
/EVQLVESGGGLVQPGGSLRLSCAASGFTFSTYAMNWVRQAPGKGLEWVGRIRSKYNNYATYYADSVKGRFTISR
DDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:402
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC 2+1 - H1.32_L1.47 - no Xtend
Chain 1 SEQ ID NO:403
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:404
/EVQLVESGGGLVQPGGSLRLSCAASGFTFSTYAMNWVRQAPGKGLEWVGRIRSKANNYATYYADSVKGRFTISR
DDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:405
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63B

2+1 – H1.89_L1.47 – no Xtend
Chain 1 SEQ ID NO:406
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:407
/EVQLVESGGGLVQPGGSLRLSCAASGFTFSTYAMNWVRQAPGKGLEWVGRIRSKYNNYATYYADSVKGRFTISR
DDSKNTLYLQMNSLRAEDTAVYYCVRHGNFGDEYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:408
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – H1.90_L1.47 – no Xtend
Chain 1 SEQ ID NO:409
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:410
/EVQLVESGGGLVQPGGSLRLSCAASGFTFSTYAMNWVRQAPGKGLEWVGRIRSKYNNYATYYADSVKGRFTISR
DDSKNTLYLQMNSLRAEDTAVYYCVRHGNFGDPYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:411
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63C

2+1 – H1.33_L1.47 – no Xtend

Chain 1 SEQ ID NO:412
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:413
/EVQLVESGGGLVQPGGSLRLSCAASGFTFS<u>TYAMN</u>WVRQAPGKGLEWVG<u>RIRSKYNNYATYYADSVKG</u>RFTISR
DDSKNTLYLQMNSLRAEDTAVYYCVR<u>HGNFGDSYVSWFDY</u>WGQGTLVTVSS/<u>GKPGSGKPGSGKPGSGKPGS</u>/QA
VVTQEPSLTVSPGGTVTLTC<u>GSSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GGGGSGGGGSKTHTCPPCP</u>/AAPPVAGPSVFLFPPKPKDTLM
ISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK

Chain 3 SEQ ID NO:414
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63D

2+1 – H1.31_L1.47 – no Xtend
Chain 1 SEQ ID NO:415
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:416
/EVQLVESGGGLVQPGGSLRLSCAASGFTFSTYAMSWVRQAPGKGLEWVGRIRSKYNNYATYYADSVKGRFTISR
DDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:417
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – L1.47_ H1.30 – no Xtend
Chain 1 SEQ ID NO:418
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:419
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:420
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63E

2+1 – L1.47_ H1.32 – no Xtend
Chain 1 SEQ ID NO:421
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:422
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKANNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:423
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC 2+1 – L1.47_ H1.89 – no Xtend
Chain 1 SEQ ID NO:424
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:425
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDEYVSWFAYWGQGTLVTVSS/GGGGSGGGGSKTHTCPPCP/AAPPVAGPSVFLFPPKPKDTLM
ISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK

Chain 3 SEQ ID NO:426
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63F

2+1 – L1.47_ H1.90 – no Xtend
Chain 1 SEQ ID NO:427
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:428
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDPYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:429
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – L1.47_ H1.33 – no Xtend
Chain 1 SEQ ID NO:430
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:431
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDSYVSWFDYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:432
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63G

2+1 - L1.47_H1.31 - no Xtend
Chain 1 SEQ ID NO:433
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 SEQ ID NO:434
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMSWVRQAPGKGLEWVGRIRSKYNNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVMHEALHNHYTQKSLSLSPGK

Chain 3 SEQ ID NO:435
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 - H1.30_L1.47 - with Xtend
Chain 1 SEQ ID NO:436
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:437
/EVQLVESGGGLVQPGGSLRLSCAASGFTFSTYAMNWVRQAPGKGLEWVGRIRSKYNNYATYYADSVKGRFTISR
DDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:438
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63H

2+1 – H1.32_L1.47 – with Xtend
Chain 1 SEQ ID NO:439
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:440
/EVQLVESGGGLVQPGGSLRLSCAASGFTFS<u>TYAMN</u>WVRQAPGKGLEWVG<u>RIRSKANNYATYYADSVKG</u>RFTISR
DDSKNTLYLQMNSLRAEDTAVYYCVR<u>HGNFGDSYVSWFAY</u>WGQGTLVTVSS/<u>GKPGSGKPGSGKPGSGKPGS</u>/QA
VVTQEPSLTVSPGGTVTLTCG<u>SSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GGGGSGGGGSKTHTCPPCP</u>/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:441
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – H1.89_L1.47 – with Xtend
Chain 1 SEQ ID NO:442
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:443
/EVQLVESGGGLVQPGGSLRLSCAASGFTFS<u>TYAMN</u>WVRQAPGKGLEWVG<u>RIRSKYNNYATYYADSVKG</u>RFTISR
DDSKNTLYLQMNSLRAEDTAVYYCVR<u>HGNFGDEYVSWFAY</u>WGQGTLVTVSS/<u>GKPGSGKPGSGKPGSGKPGS</u>/QA
VVTQEPSLTVSPGGTVTLTCG<u>SSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GGGGSGGGGSKTHTCPPCP</u>/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:444
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63I

2+1 – H1.90_L1.47 – with Xtend
Chain 1 SEQ ID NO:445
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:446
/EVQLVESGGGLVQPGGSLRLSCAASGFTFS<u>TYAMN</u>WVRQAPGKGLEWVG<u>RIRSKYNNYATYYADSVKG</u>RFTISR
DDSKNTLYLQMNSLRAEDTAVYYCVR<u>HGNFGDPYVSWFAY</u>WGQGTLVTVSS/<u>GKPGSGKPGSGKPGSGKPGS</u>/QA
VVTQEPSLTVSPGGTVTLTCG<u>SSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GGGGSGGGGSKTHTCPPCP</u>/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:447
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – H1.33_L1.47 – with Xtend
Chain 1 SEQ ID NO:448
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:449
/EVQLVESGGGLVQPGGSLRLSCAASGFTFS<u>TYAMN</u>WVRQAPGKGLEWVG<u>RIRSKYNNYATYYADSVKG</u>RFTISR
DDSKNTLYLQMNSLRAEDTAVYYCVR<u>HGNFGDSYVSWFDY</u>WGQGTLVTVSS/<u>GKPGSGKPGSGKPGSGKPGS</u>/QA
VVTQEPSLTVSPGGTVTLTCG<u>SSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GGGGSGGGGSKTHTCPPCP</u>/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:450
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63J

2+1 – H1.31_L1.47 – with Xtend
Chain 1 SEQ ID NO:451
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:452
/EVQLVESGGGLVQPGGSLRLSCAASGFTFSTYAMSWVRQAPGKGLEWVGRIRSKYNNYATYYADSVKGRFTISR
DDSKNTLYLQMNSLRAEDTAVYYCVRHGNFGDSYVSWFAYWGQGTLVTVSS/GKPGSGKPGSGKPGSGKPGS/QA
VVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:453
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – L1.47_H1.30 – with Xtend
Chain 1 SEQ ID NO:454
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:455
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:456
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63K

2+1 – L1.47_ H1.32 – with Xtend
Chain 1 SEQ ID NO:457
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:458
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKANNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:459
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC 2+1 – L1.47_ H1.89 – with Xtend
Chain 1 SEQ ID NO:460
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:461
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDEYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:462
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63L

2+1 – L1.47_ H1.90 – with Xtend
Chain 1 SEQ ID NO:463
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:464
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDPYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:465
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

2+1 – L1.47_ H1.33 – with Xtend
Chain 1 SEQ ID NO:466
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:467
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMNWVRQAPGKGLEWVGRIRSKYNNYATYYADSVKGRFTISRDDSKNTLYLQMNSLRAEDT
AVYYCVRHGNFGDSYVSWFDYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:468
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

FIGURE 63M

2+1 – L1.47_ H1.31 – with Xtend

Chain 1 SEQ ID NO:469
/ASTKGPSVFPLAPSSKSTSGGTAALGCLVKDYFPEPVTVSWNSGALTSGVHTFPAVLQSSGLYSLSSVVTVPSS
SLGTQTYICNVNHKPSDTKVDKKVEPKSCDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQ
PREPQVYTLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK

Chain 2 SEQ ID NO:470
/QAVVTQEPSLTVSPGGTVTLTCGSSTGAVTTSNYANWVQQKPGKSPRGLIGGTNKRAPGVPARFSGSLLGGKAA
LTISGAQPEDEADYYCALWYSNHWVFGGGTKLTVL/GKPGSGKPGSGKPGSGKPGS/EVQLVESGGGLVQPGGSL
RLSCAASGFTFSTYAMSWVRQAPGKGLEWVGRIRSKYNNYATYYADSVKGRFTISRDDSKNTLYLQMNSLRAEDT
AVYYCVRHGNFGDSYVSWFAYWGQGTLVTVSS/GGGGSGGGGSKTHTCPPCP/APPVAGPSVFLFPPKPKDTLMI
SRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK

Chain 3 SEQ ID NO:471
/RTVAAPSVFIFPPSDEQLKSGTASVVCLLNNFYPREAKVQWKVDNALQSGNSQESVTEQDSKDSTYSLSSTLTL
SKADYEKHKVYACEVTHQGLSSPVTKSFNRGEC

>XENP25390_[αFAP]_H0.26_L0_Fab-[αFAP]_H0.26_L0_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 670)
QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCARR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQEGDVFSCSVMHEALHNHYTQKSLSL
SPGK

Chain 2 - [αFAP]_H0.26_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 671)
QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCARR<u>RRIAYGYDEGHAMDY</u>WGQGTLVTVSS/<u>GGGGSGGGGS</u>/EVQLVESGGGLVQP
GGSLRLSCAASGFTFS<u>TYAMN</u>WVRQAPGKGLEWVGR<u>IRSKYNNYATYYADSVKG</u>RFTISRDDSKNTLYLMNSLR
AEDTAVYYCVR<u>HGNFGDSYVSWFAY</u>WGQGTLVTVSS/<u>GKPGSGKPGSGKPGSGKPGS</u>/QAVVTQEPSLTVSPGGT
VTLTC<u>GSSTGAVTTSNYAN</u>WVQQKPGKSPRGLIG<u>GTNKRAP</u>GVPARFSGSLLGGKAALTISGAQPEDEADYYC<u>AL
WYSNHWV</u>FGGGTKLTVL/<u>GGGGSGGGGSKTHTCPPCP</u>/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 672)
DIVMTQSPDSLAVSLGERATINC<u>KSSQSLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47

>XENP25393_[αFAP]_H0.26_L0_Fab-[αFAP]_H0.26_L0_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 673)
QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCARR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQEGDVFSCSVMHEALHNHYTQKSLSL
SPGK

FIGURE 64B

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 674)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 675)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.89_L1.47

>XENC1005 [αFAP]_H0.26_L0_Fab-[αFAP]_H0.26_L0_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 676)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 677)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

FIGURE 64C

Chain 3 - [αFAP]_L0 (SEQ ID NO: 678)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.90_L1.47

>XENC1006 [αFAP]_H0.26_L0_Fab-[αFAP]_H0.26_L0_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 679)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 680)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 681)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1007_[αFAP]_H0.26_L0_Fab-[αFAP]_H0.26_L0_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 682)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 683)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 684)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.31_L1.47

>XENC1008_[αFAP]_H0.26_L0_Fab-[αFAP]_H0.26_L0_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 685)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 64E

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 686)

QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCAR<u>RRIAYGYDEGHAMDY</u>WGQGTLVTVSS/<u>GGGGSGGGGS</u>/EVQLVESGGGLVQP
GGSLRLSCAASGFTFS<u>TYAMS</u>WVRQAPGKGLEWVG<u>RIRSKYNNYATYYADSVKG</u>RFTISRDDSKNTLYLQMNSLR
AEDTAVYYCV<u>RHGNFGDSYVSWFAY</u>WGQGTLVTVSS/<u>GKPGSGKPGSGKPGSGKPGS</u>/QAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYC<u>AL
WYSNHW</u>VFGGGTKLTVL/<u>GGGGSGGGGSKTHTCPPCP</u>/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 687)

DIVMTQSPDSLAVSLGERATINCK<u>SSQSLLYSRNQKNYLA</u>WYQQKPGQPPKLLIF<u>WASTRES</u>GVPDRFSGSGFGT
DFTLTISSLQAEDVAVYYC<u>QQYFSYPLT</u>FGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.30

>XENC1009 [αFAP]_H0.26_L0_Fab-[αFAP]_H0.26_L0_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 688)

QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCAR<u>RRIAYGYDEGHAMDY</u>WGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 689)

QVQLVQSGAEVKKPGASVKVSCKTSRYTFT<u>EYSIH</u>WVRQAPGQRLEWIG<u>GINPNTGIPNYNQKFKG</u>RVTITVDTS
ASTAYMELSSLRSEDTAVYYCAR<u>RRIAYGYDEGHAMDY</u>WGQGTLVTVSS/<u>GGGGSGGGGS</u>/QAVVTQEPSLTVSP
GGTVTLTC<u>GSSTGAVTTSNYAN</u>WVQQKPGKSPRGLIGG<u>TNKRAP</u>GVPARFSGSLLGGKAALTISGAQPEDEADYY
C<u>ALWYSNHW</u>VFGGGTKLTVL/<u>GKPGSGKPGSGKPGSGKPGS</u>/EVQLVESGGGLVQPGGSLRLSCAASGFTFS<u>TYA
MN</u>WVRQAPGKGLEWVG<u>RIRSKYNNYATYYADSVKG</u>RFTISRDDSKNTLYLQMNSLRAEDTAVYYCV<u>RHGNFGDSY
VSWFAY</u>WGQGTLVTVSS/<u>GGGGSGGGGSKTHTCPPCP</u>/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

FIGURE 64F

Chain 3 - [αFAP]_L0 (SEQ ID NO: 690)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.32

>XENC1010 [αFAP]_H0.26_L0_Fab-[αFAP]_H0.26_L0_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 691)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 692)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 693)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1011 [αFAP]_H0.26_L0_Fab-[αFAP]_H0.26_L0_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 694)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 695)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 696)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.90

>XENC1012 [αFAP]_H0.26_L0_Fab-[αFAP]_H0.26_L0_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 697)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 64H

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 698)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 699)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.33

>XENC1013 [αFAP]_H0.26_L0_Fab-[αFAP]_H0.26_L0_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 700)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 701)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 702)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1014 [αFAP]_H0.26_L0_Fab-[αFAP]_H0.26_L0_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 703)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQEGDVFSCSVMHEALHNHYTQKSLSL
SPGK

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 704)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0 (SEQ ID NO: 705)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.30_L1.47 – with Xtend

>XENC1015 [αFAP]_H0.26_L0_Fab-[αFAP]_H0.26_L0_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 706)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQEGDVFSCSVLHEALHSHYTQKSLSL
SPGK

FIGURE 64J

Chain 2 - [αFAP]_H0.26_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 707)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 708)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47 – with Xtend

>XENP29140 [αFAP]_H0.26_L0_Fab-[αFAP]_H0.26_L0_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 709)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 710)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 711)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 64K

H1.89_L1.47 – with Xtend

>XENC1016 [αFAP]_H0.26_L0_Fab-[αFAP]_H0.26_L0_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S Chain 1 - [αFAP]_H0.26_IgG1_C220S/S364K/E357Q/M428L/N434S (SEQ ID NO: 712)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 713)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK Chain 3 - [αFAP]_L0 (SEQ ID NO: 714)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.90_L1.47 – with Xtend

>XENC1017 [αFAP]_H0.26_L0_Fab-[αFAP]_H0.26_L0_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S Chain 1 - [αFAP]_H0.26_IgG1_C220S/S364K/E357Q/M428L/N434S (SEQ ID NO: 715)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 64L

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 716)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 717)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.33_L1.47 – with Xtend

>XENC1018 [αFAP]_H0.26_L0_Fab-[αFAP]_H0.26_L0_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 718)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 719)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 720)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 64M

H1.31_L1.47 – with Xtend

>XENC1019 [αFAP]_H0.26_L0_Fab-[αFAP]_H0.26_L0_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 721)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 722)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMSWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 723)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.30 – with Xtend

>XENC1020 [αFAP]_H0.26_L0_Fab-[αFAP]_H0.26_L0_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 724)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 64N

Chain 2 - [αFAP]_H0.26_(G4S)2 (SEQ ID NO: 1174)_[αCD3] _L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 725)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 726)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.32 – with Xtend

>XENC1021 [αFAP]_H0.26_L0_Fab-[αFAP]_H0.26_L0_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 727)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 728)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 729)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 64O

L1.47_H1.89 – with Xtend

>XENC1022 [αFAP]_H0.26_L0_Fab-[αFAP]_H0.26_L0_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 730)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 731)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 732)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.90 – with Xtend

>XENC1023 [αFAP]_H0.26_L0_Fab-[αFAP]_H0.26_L0_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 733)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 64P

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 734)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 735)

DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.33 – with Xtend

>XENC1024 [αFAP]_H0.26_L0_Fab-[αFAP]_H0.26_L0_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 736)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 737)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

FIGURE 64Q

Chain 3 - [αFAP]_L0 (SEQ ID NO: 738)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.31 – with Xtend

>XENC1025 [αFAP]_H0.26_L0_Fab-[αFAP]_H0.26_L0_Fab_(G4S)2 (SEQ ID NO: 1174)_[αCD3] L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 739)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 740)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0 (SEQ ID NO: 741)
DIVMTQSPDSLAVSLGERATINCKSSQSLLYSRNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP28118_[αFAP]_H0.26_L0.11_Fab-[αFAP]_H0.26_L0.11_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 742)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 743)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 744)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47

>XENP28116_[αFAP]_H0.26_L0.11_Fab-[αFAP]_H0.26_L0.11_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 745)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 65B

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 746)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 747)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.89_L1.47

>XENC1026 [αFAP]_H0.26_L0.11_Fab-[αFAP]_H0.26_L0.11_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 748)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 749)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 750)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1027_[αFAP]_H0.26_L0.11_Fab-[αFAP]_H0.26_L0.11_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 751)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQGDVFSCSVMHEALHNHYTQKSLSL
SPGK

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 752)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 753)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.33_L1.47

>XENC1028_[αFAP]_H0.26_L0.11_Fab-[αFAP]_H0.26_L0.11_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 754)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWQGDVFSCSVMHEALHNHYTQKSLSL
SPGK

FIGURE 65D

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 755)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 756)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.31_L1.47

>XENC1029 [αFAP]_H0.26_L0.11_Fab-[αFAP]_H0.26_L0.11_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 757)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 758)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMSWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 759)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1030 [αFAP]_H0.26_L0.11_Fab-[αFAP]_H0.26_L0.11_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 760)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 761)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 762)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.32

>XENC1031 [αFAP]_H0.26_L0.11_Fab-[αFAP]_H0.26_L0.11_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 763)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 65F

Chain 2 - [αFAP]_H0.26_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 764)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 765)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.89

>XENC1032[αFAP]_H0.26_L0.11_Fab-[αFAP]_H0.26_L0.11_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 766)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 767)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 768)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1033_[αFAP]_H0.26_L0.11_Fab-[αFAP]_H0.26_L0.11_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 769)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 770)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 771)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.33

>XENC1034_[αFAP]_H0.26_L0.11_Fab-[αFAP]_H0.26_L0.11_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 772)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 65H

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 773)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.11 (SEQ ID NO: 774)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.31

>XENC1035 [αFAP]_H0.26_L0.11_Fab-[αFAP]_H0.26_L0.11_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 775)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 776)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

FIGURE 65I

Chain 3 - [αFAP]_L0.11 (SEQ ID NO: 777)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.30_L1.47 – with Xtend

>XENC1036 [αFAP]_H0.26_L0.11_Fab-[αFAP]_H0.26_L0.11_Fab_(G4S)2 (SEQ ID NO:
1174)_[αCD3]_H1.30_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 778)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

**Chain 2 - [αFAP]_H0.26_(G4S)2 (SEQ ID NO: 1174)_[αCD3]_H1.30_L1.47_scFv(GKPGS)4 (SEQ ID NO:
4)_(G4S)2 (SEQ ID NO: 1174)_IgG1_PVA_/S267K-pI(-)_Isosteric_A_L368D/K370S/M428L/N434S (SEQ ID NO:
779)**
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 780)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47 – with Xtend

>XENP29142 [αFAP]_H0.26_L0.11_Fab-[αFAP]_H0.26_L0.11_Fab_(G4S)2 (SEQ ID NO:
1174)_[αCD3]_H1.32_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

FIGURE 65J

Chain 1 - [αFAP]_H0.26_IgG1_C220S/S364K/E357Q/M428L/N434S (SEQ ID NO: 781)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 782)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 783)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.89_L1.47 – with Xtend

>XENC1037 [αFAP]_H0.26_L0.11_Fab-[αFAP]_H0.26_L0.11_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 784)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 65K

Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 785)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 786)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.90_L1.47 – with Xtend

>XENC1038 [αFAP]_H0.26_L0.11_Fab-[αFAP]_H0.26_L0.11_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 787)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 788)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 789)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 65L

H1.33_L1.47 – with Xtend

>XENC1039 [αFAP]_H0.26_L0.11_Fab-[αFAP]_H0.26_L0.11_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 790)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 791)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 792)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.31_L1.47 – with Xtend

>XENC1040 [αFAP]_H0.26_L0.11_Fab-[αFAP]_H0.26_L0.11_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 793)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 65M

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 794)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMSWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 795)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.30 – with Xtend

>XENC1041 [αFAP]_H0.26_L0.11_Fab-[αFAP]_H0.26_L0.11_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 796)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 797)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 798)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 65N

L1.47_H1.32 – with Xtend

>XENC1042 [αFAP]_H0.26_L0.11_Fab-[αFAP]_H0.26_L0.11_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 799)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 800)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 801)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.89 – with Xtend

>XENC1043 [αFAP]_H0.26_L0.11_Fab-[αFAP]_H0.26_L0.11_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 802)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 65O

Chain 2 - [αFAP]_H0.26_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 803)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 804)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.90 – with Xtend

>XENC1044 [αFAP]_H0.26_L0.11_Fab-[αFAP]_H0.26_L0.11_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 805)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 806)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 807)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 65P

L1.47_H1.33 – with Xtend

>XENC1045[αFAP]_H0.26_L0.11_Fab-[αFAP]_H0.26_L0.11_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 808)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 809)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 810)
DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.31 – with Xtend

>XENC1046 [αFAP]_H0.26_L0.11_Fab-[αFAP]_H0.26_L0.11_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 811)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 65Q

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 812)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.11 (SEQ ID NO: 813)

DIVMTQSPDSLAVSLGERATINCKSSQSLLYSSNQKNYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP28117_[αFAP]_H0.26_L0.19_Fab-[αFAP]_H0.26_L0.19_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 814)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 815)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 816)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47

>XENP28115_[αFAP]_H0.26_L0.19_Fab-[αFAP]_H0.26_L0.19_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 817)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 66B

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 818)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 819)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.89_L1.47

>XENC1047 [αFAP]_H0.26_L0.19_Fab-[αFAP]_H0.26_L0.19_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 820)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 821)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 822)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1048_[αFAP]_H0.26_L0.19_Fab-[αFAP]_H0.26_L0.19_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 823)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 824)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 825)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.33_L1.47

>XENC1049_[αFAP]_H0.26_L0.19_Fab-[αFAP]_H0.26_L0.19_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 826)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 66D

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 827)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 828)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.31_L1.47

>XENC1050 [αFAP]_H0.26_L0.19_Fab-[αFAP]_H0.26_L0.19_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 829)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 830)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMSWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 831)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1051_[αFAP]_H0.26_L0.19_Fab-[αFAP]_H0.26_L0.19_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 832)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 833)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 834)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.32

>XENC1052_[αFAP]_H0.26_L0.19_Fab-[αFAP]_H0.26_L0.19_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 835)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 66F

Chain 2 - [αFAP]_H0.26_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 836)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 837)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.89

>XENC1053_[αFAP]_H0.26_L0.19_Fab-[αFAP]_H0.26_L0.19_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 838)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 839)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 840)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENC1054_[αFAP]_H0.26_L0.19_Fab-[αFAP]_H0.26_L0.19_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 841)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 842)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 843)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.33

>XENC1055_[αFAP]_H0.26_L0.19_Fab-[αFAP]_H0.26_L0.19_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 844)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

FIGURE 66H

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 845)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 846)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.31

>XENC1056 [αFAP]_H0.26_L0.19_Fab-[αFAP]_H0.26_L0.19_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - [αFAP]_H0.26_IgG1_C220S/S364K/E357Q (SEQ ID NO: 847)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVMHEALHNHYTQKSLSL
SPGK

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 848)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK

Chain 3 - [αFAP]_L0.19 (SEQ ID NO: 849)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 66I

H1.30_L1.47 – with Xtend

>XENC1057 [αFAP]_H0.26_L0.19_Fab-[αFAP]_H0.26_L0.19_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 850)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 851)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 852)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.32_L1.47 – with Xtend

>XENP29141 [αFAP]_H0.26_L0.19_Fab-[αFAP]_H0.26_L0.19_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 853)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 66J

Chain 2 - [αFAP]_H0.26_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 854)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKANNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 855)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.89_L1.47 – with Xtend

>XENC1058 [αFAP]_H0.26_L0.19_Fab-[αFAP]_H0.26_L0.19_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 856)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 857)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDEYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 858)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 66K

H1.90_L1.47 – with Xtend

>XENC1059 [αFAP]_H0.26_L0.19_Fab-[αFAP]_H0.26_L0.19_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 859)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 860)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDPYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 861)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.33_L1.47 – with Xtend

>XENC1060 [αFAP]_H0.26_L0.19_Fab-[αFAP]_H0.26_L0.19_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 862)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 66L

Chain 2 - [αFAP]_H0.26_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 863)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMNWVRQAPGKGLEWVGRIRSKYNNYATYYADSVKGRFTISRDDSKNTLYLQMNSLR
AEDTAVYYCVRHGNFGDSYVSWFDYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 864)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

H1.31_L1.47 – with Xtend

>XENC1061 [αFAP]_H0.26_L0.19_Fab-[αFAP]_H0.26_L0.19_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 865)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 866)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/EVQLVESGGGLVQP
GGSLRLSCAASGFTFSTYAMSWVRQAPGKGLEWVGRIRSKYNNYATYYADSVKGRFTISRDDSKNTLYLQMNSLR
AEDTAVYYCVRHGNFGDSYVSWFAYWGQGTLVTVSS/GKPGSGKPGSGKPGSGKPGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 867)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 66M

L1.47_H1.30 – with Xtend

>XENC1062 [αFAP]_H0.26_L0.19_Fab-[αFAP]_H0.26_L0.19_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 868)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 869)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 870)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.32 – with Xtend

>XENC1063 [αFAP]_H0.26_L0.19_Fab-[αFAP]_H0.26_L0.19_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 871)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 66N

Chain 2 - [αFAP]_H0.26_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 872)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKANNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 873)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.89 – with Xtend

>XENC1064 [αFAP]_H0.26_L0.19_Fab-[αFAP]_H0.26_L0.19_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 874)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 875)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDEY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 876)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

FIGURE 66O

L1.47_H1.90 – with Xtend

>XENC1065 [αFAP]_H0.26_L0.19_Fab-[αFAP]_H0.26_L0.19_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 877)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 878)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDPY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 879)
DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.33 – with Xtend

>XENC1066 [αFAP]_H0.26_L0.19_Fab-[αFAP]_H0.26_L0.19_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 880)
QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

FIGURE 66P

Chain 2 - [αFAP]_H0.26_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 881)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MNWVRQAPGKGLEWVGRIRSKYNNYATYYADSVKGRFTISRDDSKNTLYLQMNSLRAEDTAVYYCVRHGNFGDSY
VSWFDYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 882)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

L1.47_H1.31 – with Xtend

>XENC1067 [αFAP]_H0.26_L0.19_Fab-[αFAP]_H0.26_L0.19_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - [αFAP]_H0.26_IgG1_C220S/S364K/E357Q/M428L/N434S (SEQ ID NO: 883)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/ASTKGPSVFPLAPSSKSTSGGTAAL
GCLVKDYFPEPVTVSWNSGALTSGVHTFPAVLQSSGLYSLSSVVTVPSSSLGTQTYICNVNHKPSDTKVDKKVEP
KSCDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCD
VSGFYPSDIAVEWESDGQPENNYKTTPPVLDSDGSFFLYSKLTVDKSRWEQGDVFSCSVLHEALHSHYTQKSLSL
SPGK

Chain 2 - [αFAP]_H0.26_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 884)

QVQLVQSGAEVKKPGASVKVSCKTSRYTFTEYSIHWVRQAPGQRLEWIGGINPNTGIPNYNQKFKGRVTITVDTS
ASTAYMELSSLRSEDTAVYYCARRRIAYGYDEGHAMDYWGQGTLVTVSS/GGGGSGGGGS/QAVVTQEPSLTVSP
GGTVTLTCGSSTGAVTTSNYANWVQQKPGKSPRGLIGGTNKRAPGVPARFSGSLLGGKAALTISGAQPEDEADYY
CALWYSNHWVFGGGTKLTVL/GKPGSGKPGSGKPGSGKPGS/EVQLVESGGGLVQPGGSLRLSCAASGFTFSTYA
MSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GGGGSGGGGSKTHTCPPCP/APPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQP
REPQVYTLPPSREQMTKNQVKLTCLVKGFYPSDIAVEWESNGQPENNYKTTPPVLDSDGSFFLYSKLTVDKSRWQ
QGNVFSCSVLHEALHSHYTQKSLSLSPGK

Chain 3 - [αFAP]_L0.19 (SEQ ID NO: 885)

DIVMTQSPDSLAVSLGERATINCKSSQSLLYSRNQENYLAWYQQKPGQPPKLLIFWASTRESGVPDRFSGSGFGT
DFTLTISSLQAEDVAVYYCQQYFSYPLTFGQGTKVEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

>XENP25189 1A7B5[FAP]_H1L1_Fab-1A7B5[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 886)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 887)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 888)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47

>XENP25195 1A7B5[FAP]_H1L1_Fab-1A7B5[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 889)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 67B

Chain 2 - 1A7B5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 890)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 891)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47

>XENC1068 1A7B5[FAP]_H1L1_Fab-1A7B5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 892)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 893)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 894)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1069 1A7B5[FAP]_H1L1_Fab-1A7B5[FAP]_H1L1_Fab_(G4S)2 (SEQ ID NO:
1174)_[αCD3]_H1.90_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 -  1A7B5[FAP]_H1_IgG1_C220S/S364K/E357Q (SEQ ID NO: 895)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

**Chain 2 -  1A7B5[FAP]_H1_(G4S)2 (SEQ ID NO: 1174)_[αCD3]_H1.90_L1.47_scFv(GKPGS)4 (SEQ ID NO:
4)_(G4S)2 (SEQ ID NO: 1174)_IgG1_PVA_/S267K-pI(-)_Isosteric_A_L368D/K370S (SEQ ID NO: 896)**
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 -  1A7B5[FAP]_L1 (SEQ ID NO: 897)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47

>XENC1070 1A7B5[FAP]_H1L1_Fab-1A7B5[FAP]_H1L1_Fab_(G4S)2 (SEQ ID NO:
1174)_[αCD3]_H1.33_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 -  1A7B5[FAP]_H1_IgG1_C220S/S364K/E357Q (SEQ ID NO: 898)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 67D

Chain 2 - 1A7B5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 899)

EVQLLESGGGLVQPGGSLRLSCAASGFTFS<u>SYAMS</u>WVRQAPGKGLEWVS<u>GISGGGGSTYYADSVK</u>GRFTISRDNS
KNTLYLQMNSLRAEDTAVYYCAK<u>IAHSRIGWHFDY</u>WGQGTLVTVSS/GGGGSGGGGS/EVQLVESGGGLVQPGGS
LRLSCAASGFTFS<u>TYAMN</u>WVRQAPGKGLEWVG<u>RIRSKYNNYATYYADSVK</u>GRFTISRDDSKNTLYLQMNSLRAED
TAVYYCVR<u>HGNFGDSYVSWFDY</u>WGQGTLVTVSS/GKPGSGKPGSGKPGSGKPGS/QAVVTQEPSLTVSPGGTVTL
TCGSSTGAVTTSNYANWVQQKPGKSPRGLIG<u>GTNKRAP</u>GVPARFSGSLLGGKAALTISGAQPEDEADYYC<u>ALWYS
NHWV</u>FGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 900)

DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47

>XENC1071 1A7B5[FAP]_H1L1_Fab-1A7B5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 901)

EVQLLESGGGLVQPGGSLRLSCAASGFTFS<u>SYAMS</u>WVRQAPGKGLEWVS<u>GISGGGGSTYYADSVK</u>GRFTISRDNS
KNTLYLQMNSLRAEDTAVYYCAK<u>IAHSRIGWHFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 902)

EVQLLESGGGLVQPGGSLRLSCAASGFTFS<u>SYAMS</u>WVRQAPGKGLEWVS<u>GISGGGGSTYYADSVK</u>GRFTISRDNS
KNTLYLQMNSLRAEDTAVYYCAK<u>IAHSRIGWHFDY</u>WGQGTLVTVSS/GGGGSGGGGS/EVQLVESGGGLVQPGGS
LRLSCAASGFTFS<u>TYAMS</u>WVRQAPGKGLEWVG<u>RIRSKYNNYATYYADSVK</u>GRFTISRDDSKNTLYLQMNSLRAED
TAVYYCVR<u>HGNFGDSYVSWFAY</u>WGQGTLVTVSS/GKPGSGKPGSGKPGSGKPGS/QAVVTQEPSLTVSPGGTVTL
TCGSSTGAVTTSNYANWVQQKPGKSPRGLIG<u>GTNKRAP</u>GVPARFSGSLLGGKAALTISGAQPEDEADYYC<u>ALWYS
NHWV</u>FGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 903)

DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1072 1A7B5[FAP]_H1L1_Fab-1A7B5[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 904)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 905)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 906)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32

>XENC1073 1A7B5[FAP]_H1L1_Fab-1A7B5[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 907)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 67F

Chain 2 - 1A7B5[FAP]_H1_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 908)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 909)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89

>XENC1074 1A7B5[FAP]_H1L1_Fab-1A7B5[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 910)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 911)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 912)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1075 1A7B5[FAP]_H1L1_Fab-1A7B5[FAP]_H1L1_Fab_(G4S)2 (SEQ ID NO:
1174)_[αCD3]_L1.47_H1.90_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 - 1A7B5[FAP]_H1_IgG1_C220S/S364K/E357Q (SEQ ID NO: 913)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

**Chain 2 - 1A7B5[FAP]_H1_(G4S)2 (SEQ ID NO: 1174)_[αCD3]_L1.47_H1.90_scFv(GKPGS)4 (SEQ ID NO:
4)_(G4S)2 (SEQ ID NO: 1174)_IgG1_PVA_/S267K-pI(-)_Isosteric_A_L368D/K370S (SEQ ID NO: 914)**
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 915)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33

>XENC1076 1A7B5[FAP]_H1L1_Fab-1A7B5[FAP]_H1L1_Fab_(G4S)2 (SEQ ID NO:
1174)_[αCD3]_L1.47_H1.33_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 - 1A7B5[FAP]_H1_IgG1_C220S/S364K/E357Q (SEQ ID NO: 916)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 67H

Chain 2 - 1A7B5[FAP]_H1_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 917)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 918)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31

>XENC1077 1A7B5[FAP]_H1L1_Fab-1A7B5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1A7B5[FAP]_H1_IgG1_C220S/S364K/E357Q (SEQ ID NO: 919)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1A7B5[FAP]_H1_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 920)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1A7B5[FAP]_L1 (SEQ ID NO: 921)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 67I

H1.30_L1.47 – with Xtend

\>XENC1078 1A7B5[FAP]_H1L1_Fab-1A7B5[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 922)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 923)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 924)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47 – with Xtend

\>XENC1079 1A7B5[FAP]_H1L1_Fab-1A7B5[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 925)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 67J

Chain 2 - 1A7B5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 926)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 927)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47 – with Xtend

>XENC1080 1A7B5[FAP]_H1L1_Fab-1A7B5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 928)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 929)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 930)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 67K

H1.90_L1.47 – with Xtend

>XENC1081 1A7B5[FAP]_H1L1_Fab-1A7B5[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 931)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 932)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 933)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47 – with Xtend

>XENC1082 1A7B5[FAP]_H1L1_Fab-1A7B5[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 934)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 67L

Chain 2 - 1A7B5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 935)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 936)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47 – with Xtend

>XENC1083 1A7B5[FAP]_H1L1_Fab-1A7B5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 937)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 938)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 939)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 67M

L1.47_H1.30 – with Xtend

>XENC1084 1A7B5[FAP]_H1L1_Fab-1A7B5[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 940)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 941)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 942)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32 – with Xtend

>XENC1085 1A7B5[FAP]_H1L1_Fab-1A7B5[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 943)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 67N

Chain 2 - 1A7B5[FAP]_H1_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 944)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 945)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89 – with Xtend

>XENC1086 1A7B5[FAP]_H1L1_Fab-1A7B5[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 946)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 947)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 948)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 67O

L1.47_H1.90 – with Xtend

>XENC1087 1A7B5[FAP]_H1L1_Fab-1A7B5[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 949)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 950)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 951)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33 – with Xtend

>XENC1088 1A7B5[FAP]_H1L1_Fab-1A7B5[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 952)
EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 67P

Chain 2 - 1A7B5[FAP]_H1_(G4S)2 (SEQ ID NO: 1174)_[αCD3] _L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 953)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 954)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31 – with Xtend

>XENC1089 1A7B5[FAP]_H1L1_Fab-1A7B5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1A7B5[FAP]_H1_IgG1_C220S/S364K/E357Q/M428L/N434S (SEQ ID NO: 955)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1A7B5[FAP]_H1_(G4S)2 (SEQ ID NO: 1174)_[αCD3] _L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 956)

EVQLLESGGGLVQPGGSLRLSCAASGFTFSSYAMSWVRQAPGKGLEWVSGISGGGGSTYYADSVKGRFTISRDNS
KNTLYLQMNSLRAEDTAVYYCAKIAHSRIGWHFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1A7B5[FAP]_L1 (SEQ ID NO: 957)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP25966 1E5A5[FAP]_H1L1_Fab-1E5A5[FAP]_H1L1_Fab_(G4S)2 (SEQ ID NO:
1174)_[αCD3]_H1.30_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 -  1E5A5[FAP]_H1_IgG1_C220S/S364K/E357Q (SEQ ID NO: 958)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

**Chain 2 -  1E5A5[FAP]_H1_(G4S)2 (SEQ ID NO: 1174)_[αCD3]_H1.30_L1.47_scFv(GKPGS)4 (SEQ ID NO:
4)_(G4S)2 (SEQ ID NO: 1174)_IgG1_PVA_/S267K-pI(-)_Isosteric_A_L368D/K370S (SEQ ID NO: 959)**
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 -  1E5A5[FAP]_L1 (SEQ ID NO: 960)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47

>XENP25967 1E5A5[FAP]_H1L1_Fab-1E5A5[FAP]_H1L1_Fab_(G4S)2 (SEQ ID NO:
1174)_[αCD3]_H1.32_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S-IgG1_C220S/S364K/E357Q

Chain 1 -  1E5A5[FAP]_H1_IgG1_C220S/S364K/E357Q (SEQ ID NO: 961)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 68B

Chain 2 - 1E5A5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 962)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 963)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47

>XENC1090 1E5A5[FAP]_H1L1_Fab-1E5A5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 964)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 965)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 966)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1091_1E5A5[FAP]_H1L1_Fab-1E5A5[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 967)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 968)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 969)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47

>XENC1092_1E5A5[FAP]_H1L1_Fab-1E5A5[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 970)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 68D

Chain 2 - 1E5A5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 971)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 972)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47

>XENC1093 1E5A5[FAP]_H1L1_Fab-1E5A5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 973)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 974)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 975)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

\>XENC1094 1E5A5[FAP]_H1L1_Fab-1E5A5[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 976)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 977)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 978)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32

\>XENC1095 1E5A5[FAP]_H1L1_Fab-1E5A5[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 979)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 68F

Chain 2 - 1E5A5[FAP]_H1_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 980)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 981)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89

>XENC1096 1E5A5[FAP]_H1L1_Fab-1E5A5[FAP]_H1L1_Fab_(G4S)2 (SEQ ID NO: 1174) _[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 982)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 983)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 984)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1097 1E5A5[FAP]_H1L1_Fab-1E5A5[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI{-}_Isosteric_A_L368D/K370S-IgG1_C220S/S364K/E357Q

Chain 1 - 1E5A5[FAP]_H1_IgG1_C220S/S364K/E357Q (SEQ ID NO: 985)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI{-}_Isosteric_A_L368D/K370S (SEQ ID NO: 986)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 987)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33

>XENC1098 1E5A5[FAP]_H1L1_Fab-1E5A5[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI{-}_Isosteric_A_L368D/K370S-IgG1_C220S/S364K/E357Q

Chain 1 - 1E5A5[FAP]_H1_IgG1_C220S/S364K/E357Q (SEQ ID NO: 988)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 68H

Chain 2 - 1E5A5[FAP]_H1_(G4S)2 (SEQ ID NO: 1174)_[αCD3] _L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 989)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 990)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31

>XENC1099 1E5A5[FAP]_H1L1_Fab-1E5A5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5[FAP]_H1_IgG1_C220S/S364K/E357Q (SEQ ID NO: 991)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5[FAP]_H1_(G4S)2 (SEQ ID NO: 1174)_[αCD3] _L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 992)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5[FAP]_L1 (SEQ ID NO: 993)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 68I

H1.30_L1.47 – with Xtend

>XENC1100 1E5A5[FAP]_H1L1_Fab-1E5A5[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 994)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 995)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/<u>GGGGSGGGGS</u>/EVQLVESGGGLVQPGGS
LRLSCAASGFTFS<u>TYAMN</u>WVRQAPGKGLEWVG<u>RIRSKYNNYATYYADSVKG</u>RFTISRDDSKNTLYLQMNSLRAED
TAVYYCVRH<u>GNFGDSYVSWFAY</u>WGQGTLVTVSS/<u>GKPGSGKPGSGKPGSGKPGS</u>/QAVVTQEPSLTVSPGGTVTL
TCGSSTGAVTTSNYANWVQQKPGKSPRGLIGGTN<u>KRA</u>PGVPARFSGSLLGGKAALTISGAQPEDEADYYCAL<u>WYS
NHWV</u>FGGGTKLTVL/<u>GGGGSGGGGSKTHTCPPCP</u>/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 996)
DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSSPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47 – with Xtend

>XENC1101 1E5A5[FAP]_H1L1_Fab-1E5A5[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 997)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 68J

Chain 2 - 1E5A5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 998)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 999)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47 – with Xtend

>XENC1102 1E5A5[FAP]_H1L1_Fab-1E5A5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1000)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1001)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1002)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 68K

H1.90_L1.47 – with Xtend

>XENC1103 1E5A5[FAP]_H1L1_Fab-1E5A5[FAP]_H1L1_Fab_(G4S)2 (SEQ ID NO:
1174)_[αCD3]_H1.90_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1003)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

**Chain 2 - 1E5A5[FAP]_H1_(G4S)2 (SEQ ID NO: 1174)_[αCD3]_H1.90_L1.47_scFv(GKPGS)4 (SEQ ID NO:
4)_(G4S)2 (SEQ ID NO: 1174)_IgG1_PVA_/S267K-pI(-)_Isosteric_A_L368D/K370S/M428L/N434S (SEQ ID NO:
1004)**
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/<u>GGGGSGGGGS</u>/EVQLVESGGGLVQPGGS
LRLSCAASGFTFS<u>TYAMN</u>WVRQAPGKGLEWVG<u>RIRSKYNNYATYYADSVKG</u>RFTISRDDSKNTLYLQMNSLRAED
TAVYYCVRH<u>GNFGDPYVSWFAY</u>WGQGTLVTVSS/<u>GKPGSGKPGSGKPGSGKPGS</u>/QAVVTQEPSLTVSPGGTVTL
TCGSSTGAVTTSNYANWVQQKPGKSPRGLIGGTNKRAPGVPARFSGSLLGGKAALTISGAQPEDEADYYCAL<u>WYS
NHWV</u>FGGGTKLTVL/<u>GGGGSGGGGSKTHTCPPCP</u>/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1005)
DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSSPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47 – with Xtend

>XENC1104 1E5A5[FAP]_H1L1_Fab-1E5A5[FAP]_H1L1_Fab_(G4S)2 (SEQ ID NO:
1174)_[αCD3]_H1.33_L1.47_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1006)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 68L

Chain 2 - 1E5A5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1007)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1008)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47 – with Xtend

>XENC1105 1E5A5[FAP]_H1L1_Fab-1E5A5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1009)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1010)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1011)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 68M

L1.47_H1.30 – with Xtend

>XENC1106 1E5A5[FAP]_H1L1_Fab-1E5A5[FAP]_H1L1_Fab_(G4S)2 (SEQ ID NO:
1174)_[αCD3]_L1.47_H1.30_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1012)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

**Chain 2 - 1E5A5[FAP]_H1_(G4S)2 (SEQ ID NO: 1174)_[αCD3]_L1.47_H1.30_scFv(GKPGS)4 (SEQ ID NO:
4)_(G4S)2 (SEQ ID NO: 1174)_IgG1_PVA_/S267K-pI(-)_Isosteric_A_L368D/K370S/M428L/N434S (SEQ ID NO:
1013)**
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1014)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32 – with Xtend

>XENC1107 1E5A5[FAP]_H1L1_Fab-1E5A5[FAP]_H1L1_Fab_(G4S)2 (SEQ ID NO:
1174)_[αCD3]_L1.47_H1.32_scFv(GKPGS)4 (SEQ ID NO: 4)_(G4S)2 (SEQ ID NO: 1174)_IgG1_PVA_/S267K-pI(-
)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1015)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 68N

Chain 2 - 1E5A5[FAP]_H1_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1016)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1017)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89 – with Xtend

>XENC1108 1E5A5[FAP]_H1L1_Fab-1E5A5[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1018)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1019)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1020)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 68O

L1.47_H1.90 – with Xtend

>XENC1109 1E5A5[FAP]_H1L1_Fab-1E5A5[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1021)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1022)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1023)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33 – with Xtend

>XENC1110 1E5A5[FAP]_H1L1_Fab-1E5A5[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1024)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 68P

Chain 2 - 1E5A5[FAP]_H1_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1025)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1026)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31 – with Xtend

>XENC1111 1E5A5[FAP]_H1L1_Fab-1E5A5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5[FAP]_H1_IgG1_C220S/S364K/E357Q/M428L/N434S (SEQ ID NO: 1027)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5[FAP]_H1_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1028)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5[FAP]_L1 (SEQ ID NO: 1029)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSSPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP25188 1E5A5(COMMONLC)[FAP]_H1L1_Fab-1E5A5(COMMONLC)[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1030)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1031)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1032)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47

>XENP25194 1E5A5(COMMONLC)[FAP]_H1L1_Fab-1E5A5(COMMONLC)[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1033)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 69B

Chain 2 - 1E5A5(COMMONLC)[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1034)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1035)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47

>XENC1112 1E5A5(COMMONLC)[FAP]_H1L1_Fab-1E5A5(COMMONLC)[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1036)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1037)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1038)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

\>XENC1113 1E5A5(COMMONLC)[FAP]_H1L1_Fab-1E5A5(COMMONLC)[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1039)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1040)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1041)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47

\>XENC1114 1E5A5(COMMONLC)[FAP]_H1L1_Fab-1E5A5(COMMONLC)[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1042)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 69D

Chain 2 - 1E5A5(COMMONLC)[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1043)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1044)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47

>XENC1115 1E5A5(COMMONLC)[FAP]_H1L1_Fab-1E5A5(COMMONLC)[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1045)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1046)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1047)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1116 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1048)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1049)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1050)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32

>XENC1117 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1051)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 69F

Chain 2 - 1E5A5(COMMONLC)[FAP]_H1_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1052)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/<u>GGGGSGGGGS</u>/QAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYC<u>AL
WYSNHWV</u>FGGGTKLTVL/<u>GKPGSGKPGSGKPGSGKPGS</u>/EVQLVESGGGLVQPGGSLRLSCAASGFTFS<u>TYAMN</u>W
VRQAPGKGLEWVG<u>RIRSKANNYATYYADSVKG</u>RFTISRDDSKNTLYLQMNSLRAEDTAVYYCVR<u>HGNFGDSYVSW
FAY</u>WGQGTLVTVSS/<u>GGGGSGGGGS</u>KTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1053)
DIQMTQSPSSLSASVGDRVTITC<u>RASQSISSYLNW</u>YQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89

>XENC1118 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1054)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1055)
EVQLLESGGGLVQPGGSLRLSCAASGFTFS<u>SYAMS</u>WVRQAPGKGLEWVS<u>GISGSGGSTYYADSVKG</u>RFTISRDNS
KNTLYLQMNSLRAEDTAVYYCAK<u>ISFYPGGTYFDY</u>WGQGTLVTVSS/<u>GGGGSGGGGS</u>/QAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYC<u>AL
WYSNHWV</u>FGGGTKLTVL/<u>GKPGSGKPGSGKPGSGKPGS</u>/EVQLVESGGGLVQPGGSLRLSCAASGFTFS<u>TYAMN</u>W
VRQAPGKGLEWVG<u>RIRSKYNNYATYYADSVKG</u>RFTISRDDSKNTLYLQMNSLRAEDTAVYYCVR<u>HGNFGDEYVSW
FAY</u>WGQGTLVTVSS/<u>GGGGSGGGGS</u>KTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1056)
DIQMTQSPSSLSASVGDRVTITC<u>RASQSISSYLNW</u>YQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1119 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1057)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1058)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1059)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33

>XENC1120 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1060)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 69H

Chain 2 - 1E5A5(COMMONLC)[FAP]_H1_(G4S)2 (SEQ ID NO: 1174)_[αCD3] _L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1061)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1062)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31

>XENC1121 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1E5A5(COMMONLC)[FAP]_H1_IgG1_C220S/S364K/E357Q (SEQ ID NO: 1063)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1E5A5(COMMONLC)[FAP]_H1_(G4S)2 (SEQ ID NO: 1174)_[αCD3] _L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1064)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1E5A5(COMMONLC)[FAP]_L1 (SEQ ID NO: 1065)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 69I

H1.30_L1.47 – with Xtend

>XENC1122 1E5A5(COMMONLC)[FAP]_H1L1_Fab-1E5A5(COMMONLC)[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1066)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1067)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1068)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47 – with Xtend

>XENC1123 1E5A5(COMMONLC)[FAP]_H1L1_Fab-1E5A5(COMMONLC)[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1069)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 69J

Chain 2 - 1E5A5(COMMONLC)[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1070)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1071)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47 – with Xtend

>XENC1124 1E5A5(COMMONLC)[FAP]_H1L1_Fab-1E5A5(COMMONLC)[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1072)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1073)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1074)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 69K

H1.90_L1.47 – with Xtend

>XENC1125 1E5A5(COMMONLC)[FAP]_H1L1_Fab-1E5A5(COMMONLC)[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1075)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1076)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1077)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47 – with Xtend

>XENC1126 1E5A5(COMMONLC)[FAP]_H1L1_Fab-1E5A5(COMMONLC)[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1078)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 69L

Chain 2 - 1E5A5(COMMONLC)[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1079)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1080)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47 – with Xtend

>XENC1127 1E5A5(COMMONLC)[FAP]_H1L1_Fab-1E5A5(COMMONLC)[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1081)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1082)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1083)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 69M

L1.47_H1.30 – with Xtend

>XENC1128 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1084)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1085)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1086)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32 – with Xtend

>XENC1129 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1087)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 69N

Chain 2 - 1E5A5(COMMONLC)[FAP]_H1_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1088)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1089)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89 – with Xtend

>XENC1130 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1090)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1091)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1092)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 69O

L1.47_H1.90 – with Xtend

>XENC1131 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1093)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1094)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1095)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33 – with Xtend

>XENC1132 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1096)
EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 69P

Chain 2 - 1E5A5(COMMONLC)[FAP]_H1_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1097)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1098)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31 – with Xtend

>XENC1133 1E5A5(COMMONLC)[FAP]_H1L1_Fab-1E5A5(COMMONLC)[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1E5A5(COMMONLC)[FAP]_H1_IgG1_C220S/S364K/E357Q/M428L/N434S (SEQ ID NO: 1099)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1E5A5(COMMONLC)[FAP]_H1_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1100)

EVQLLESGGGLVQPGGSLRLSCAASGFTFSSYAMSWVRQAPGKGLEWVSGISGSGGSTYYADSVKGRFTISRDNS
KNTLYLQMNSLRAEDTAVYYCAKISFYPGGTYFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1E5A5(COMMONLC)[FAP]_L1 (SEQ ID NO: 1101)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP25187 1F4B5[FAP]_H1L1_Fab-1F4B5[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1102)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1103)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1104)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47

>XENP25193 1F4B5[FAP]_H1L1_Fab-1F4B5[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1105)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 70B

Chain 2 - 1F4B5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1106)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1107)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47

>XENC1134 1F4B5[FAP]_H1L1_Fab-1F4B5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1108)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1109)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1110)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1135 1F4B5[FAP]_H1L1_Fab-1F4B5[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1111)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1112)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1113)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47

>XENC1136 1F4B5[FAP]_H1L1_Fab-1F4B5[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1114)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 70D

Chain 2 - 1F4B5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1115)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1116)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47

>XENC1137 1F4B5[FAP]_H1L1_Fab-1F4B5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1117)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1118)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1119)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1138 1F4B5[FAP]_H1L1_Fab-1F4B5[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1120)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1121)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1122)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32

>XENC1139 1F4B5[FAP]_H1L1_Fab-1F4B5[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1123)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 70F

Chain 2 - 1F4B5[FAP]_H1_(G4S)2 (SEQ ID NO: 1174)_[αCD3] _L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1124)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKANNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1125)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89

>XENC1140 1F4B5[FAP]_H1L1_Fab-1F4B5[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1126)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3] _L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1127)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDEYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1128)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENC1141 1F4B5[FAP]_H1L1_Fab-1F4B5[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1129)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1130)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1131)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33

>XENC1142 1F4B5[FAP]_H1L1_Fab-1F4B5[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1132)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

FIGURE 70H

Chain 2 - 1F4B5[FAP]_H1_(G4S)2 (SEQ ID NO: 1174)_[αCD3] _L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1133)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1134)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31

>XENC1143 1F4B5[FAP]_H1L1_Fab-1F4B5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S-IgG1_C220S/S364K/E357Q

Chain 1 - 1F4B5[FAP]_H1_IgG1_C220S/S364K/E357Q (SEQ ID NO: 1135)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 - 1F4B5[FAP]_H1_(G4S)2 (SEQ ID NO: 1174)_[αCD3] _L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S (SEQ ID NO: 1136)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK

Chain 3 - 1F4B5[FAP]_L1 (SEQ ID NO: 1137)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 70I

H1.30_L1.47 – with Xtend

>XENC1144 1F4B5[FAP]_H1L1_Fab-1F4B5[FAP]_H1L1_Fab_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1138)
EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_H1.30_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1139)
EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/<u>GGGGSGGGGS</u>/EVQLVESGGGLVQPGGS
LRLSCAASGFTFS<u>TYAMN</u>WVRQAPGKGLEWVG<u>RIRSKYNNYATYYADSVKG</u>RFTISRDDSKNTLYLQMNSLRAED
TAVYYCVR<u>HGNFGDSYVSWFAY</u>WGQGTLVTVSS/<u>GKPGSGKPGSGKPGSGKPGS</u>/QAVVTQEPSLTVSPGGTVTL
TCGSSTGAVTTSNYANWVQQKPGKSPRGLIGGTNKRAPGVPARFSGSLLGGKAALTISGAQPEDEADYYCA<u>LWYS
NHWV</u>FGGGTKLTVL/<u>GGGGSGGGGSKTHTCPPCP</u>/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1140)
DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.32_L1.47 – with Xtend

>XENC1145 1F4B5[FAP]_H1L1_Fab-1F4B5[FAP]_H1L1_Fab_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1141)
EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 70J

Chain 2 - 1F4B5[FAP]_H1_(G4S)2 (SEQ ID NO: 1174)_[αCD3]_H1.32_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1142)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKANNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1143)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.89_L1.47 – with Xtend

>XENC1146 1F4B5[FAP]_H1L1_Fab-1F4B5[FAP]_H1L1_Fab_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1144)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_H1.89_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1145)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDEYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1146)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 70K

H1.90_L1.47 – with Xtend

>XENC1147 1F4B5[FAP]_H1L1_Fab-1F4B5[FAP]_H1L1_Fab_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1147)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_H1.90_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1148)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDPYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1149)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.33_L1.47 – with Xtend

>XENC1148 1F4B5[FAP]_H1L1_Fab-1F4B5[FAP]_H1L1_Fab_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1150)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 70L

Chain 2 - 1F4B5[FAP]_H1_(G4S)2 (SEQ ID NO: 1174)_[αCD3]_H1.33_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1151)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMNWVRQAPGKGLEWVGRIRSKYNNYATYYADSVKGRFTISRDDSKNTLYLQMNSLRAED
TAVYYCVRHGNFGDSYVSWFDYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1152)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

H1.31_L1.47 – with Xtend

>XENC1149 1F4B5[FAP]_H1L1_Fab-1F4B5[FAP]_H1L1_Fab_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1153)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_H1.31_L1.47_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1154)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/EVQLVESGGGLVQPGGS
LRLSCAASGFTFSTYAMSWVRQAPGKGLEWVGRIRSKYNNYATYYADSVKGRFTISRDDSKNTLYLQMNSLRAED
TAVYYCVRHGNFGDSYVSWFAYWGQGTLVTVSS/GKPGSGKPGSGKPGSGKPGS/QAVVTQEPSLTVSPGGTVTL
TCGSSTGAVTTSNYANWVQQKPGKSPRGLIGGTNKRAPGVPARFSGSLLGGKAALTISGAQPEDEADYYCALWYS
NHWVFGGGTKLTVL/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1155)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 70M

L1.47_H1.30 – with Xtend

>XENC1150 1F4B5[FAP]_H1L1_Fab-1F4B5[FAP]_H1L1_Fab_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1156)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_L1.47_H1.30_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1157)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1158)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.32 – with Xtend

>XENC1151 1F4B5[FAP]_H1L1_Fab-1F4B5[FAP]_H1L1_Fab_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1159)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 70N

Chain 2 - 1F4B5[FAP]_H1_(G4S)2 (SEQ ID NO: 1174)_[αCD3]_L1.47_H1.32_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1160)

EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/<u>GGGGSGGGGS</u>/QAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYCAL
<u>WYSNHWV</u>FGGGTKLTVL/<u>GKPGSGKPGSGKPGSGKPGS</u>/EVQLVESGGGLVQPGGSLRLSCAASGFTFS<u>TYAMNW</u>
VRQAPGKGLEWVG<u>RIRSKANNYATYYADSVKG</u>RFTISRDDSKNTLYLQMNSLRAEDTAVYYCVR<u>HGNFGDSYVSW
FAY</u>WGQGTLVTVSS/<u>GGGGSGGGGSKTHTCPPCP</u>/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1161)

DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.89 – with Xtend

>XENC1152 1F4B5[FAP]_H1L1_Fab-1F4B5[FAP]_H1L1_Fab_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1162)

EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_L1.47_H1.89_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1163)

EVQLLESGGGLVQPGGSLRLSCAASGFTFS<u>RYAMT</u>WVRQAPGKGLEWVS<u>SISASGGSTYYADSVKG</u>RFTISRDNS
KNTLYLQMNSLRAEDTAVYYCAK<u>TFSGYAHYDFDY</u>WGQGTLVTVSS/<u>GGGGSGGGGS</u>/QAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYCAL
<u>WYSNHWV</u>FGGGTKLTVL/<u>GKPGSGKPGSGKPGSGKPGS</u>/EVQLVESGGGLVQPGGSLRLSCAASGFTFS<u>TYAMNW</u>
VRQAPGKGLEWVG<u>RIRSKYNNYATYYADSVKG</u>RFTISRDDSKNTLYLQMNSLRAEDTAVYYCVR<u>HGNFGDEYVSW
FAY</u>WGQGTLVTVSS/<u>GGGGSGGGGSKTHTCPPCP</u>/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1164)

DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIGURE 70O

L1.47_H1.90 – with Xtend

>XENC1153 1F4B5[FAP]_H1L1_Fab-1F4B5[FAP]_H1L1_Fab_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1165)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_L1.47_H1.90_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1166)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDPYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1167)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.33 – with Xtend

>XENC1154 1F4B5[FAP]_H1L1_Fab-1F4B5[FAP]_H1L1_Fab_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1168)
EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

FIGURE 70P

Chain 2 - 1F4B5[FAP]_H1_(G4S)2 (SEQ ID NO: 1174)_[αCD3]_L1.47_H1.33_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1169)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMNW
VRQAPGKGLEWVGRIRSKYNNYATYYADSVKGRFTISRDDSKNTLYLQMNSLRAEDTAVYYCVRHGNFGDSYVSW
FDYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1170)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

L1.47_H1.31 – with Xtend

>XENC1155 1F4B5[FAP]_H1L1_Fab-1F4B5[FAP]_H1L1_Fab_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S-IgG1_C220S/S364K/E357Q/M428L/N434S

Chain 1 - 1F4B5[FAP]_H1_IgG1_C220S/S364K/E357Q/M428L/N434S (SEQ ID NO: 1171)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVLHEALHSHYTQKSLSLSPG
K

Chain 2 - 1F4B5[FAP]_H1_(G4S)2 (SEQ ID NO: 1174)_[αCD3]_L1.47_H1.31_scFv(GKPGS)4 (SEQ ID NO: 4)_(G4S)2 (SEQ ID NO: 1174)_IgG1_PVA_/S267K-pI(-)_Isosteric_A_L368D/K370S/M428L/N434S (SEQ ID NO: 1172)

EVQLLESGGGLVQPGGSLRLSCAASGFTFSRYAMTWVRQAPGKGLEWVSSISASGGSTYYADSVKGRFTISRDNS
KNTLYLQMNSLRAEDTAVYYCAKTFSGYAHYDFDYWGQGTLVTVSS/GGGGSGGGGS/QAVVTQEPSLTVSPGGT
VTLTCGSSTGAVTTSNYANWVQQKPGKSPRGLIGGTNKRAPGVPARFSGSLLGGKAALTISGAQPEDEADYYCAL
WYSNHWVFGGGTKLTVL/GKPGSGKPGSGKPGSGKPGS/EVQLVESGGGLVQPGGSLRLSCAASGFTFSTYAMSW
VRQAPGKGLEWVGRIRSKYNNYATYYADSVKGRFTISRDDSKNTLYLQMNSLRAEDTAVYYCVRHGNFGDSYVSW
FAYWGQGTLVTVSS/GGGGSGGGGSKTHTCPPCP/APPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREP
QVYTLPPSREMTKNQVKLTCLVKGFYPSDIAVEWESNGQPENNYKTTPPVLDSDGSFFLYSKLTVDKSRWQQGN
VFSCSVLHEALHSHYTQKSLSLSPGK

Chain 3 - 1F4B5[FAP]_L1 (SEQ ID NO: 1173)

DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

HETERODIMERIC ANTIBODIES THAT BIND FIBROBLAST ACTIVATION PROTEIN

PRIORITY CLAIM

This application claims the benefit of U.S. Provisional Application No. 62/652,835, filed Apr. 4, 2018, which is expressly incorporated herein by reference in its entirety, with particular reference to the figures, legends, and claims therein.

SEQUENCE LISTING

The instant application contains a Sequence Listing which has been filed electronically in ASCII format and is hereby incorporated by reference in its entirety. Said ASCII copy, created on May 16, 2019, is named 067461-5219-US_SL.txt and is 3,509,162 bytes in size.

BACKGROUND

Antibody-based therapeutics have been successfully used to treat a variety of diseases, including cancer. An increasingly prevalent avenue being explored is the engineering of single immunoglobulin molecules that co-engage two different antigens. Such alternate antibody formats that engage two different antigens are often referred to as bispecific antibodies. Because the considerable diversity of the antibody variable region (Fv) makes it possible to produce an Fv that recognizes virtually any molecule, the typical approach to bispecific antibody generation is the introduction of new variable regions into the antibody.

A particularly useful approach for bispecific antibodies is to engineer a first binding domain that engages CD3 and a second binding domain that engages an antigen associated with or upregulated on cancer cells so that the bispecific antibody redirects CD3$^+$ T cells to destroy the cancer cells. However, tumor cells may shed these antigens as part of cancer immunoediting (Hochst and Diehl, 2012), contributing to their immune escape and decreasing the efficacy of such treatments which target cancer-associated antigens. Therefore, another approach is to target other cells in the tumor environment known to support tumor cell survival.

Fibroblasts represent a majority of stromal cells in the tumor environment. These cancer-associated fibroblasts (CAFs) have been reported to promote tumor survival and proliferation (Orimo & Weinberg, Cell Cycle 5(15): 1597-1601 (2006); Xing et al., Front Biosci. 15: 166-170 (2011)), for example by providing growth factors for angiogenesis and by encouraging an immunosuppressive environment, and have been associated with poor prognosis (Underwood et al, J. Path 235: 466-477 (2015)).

Fibroblast activation protein (FAP) is a serine protease involved in extracellular matrix remodeling (Kelly et al. 2012). As shown herein, FAP is found to be generally elevated in CAFs in comparison with normal tissue, thus, making FAP a suitable target for cancer therapies.

Provided herein are novel FAP binding domains and antibodies that include such binding domains (e.g., FAP× CD3 bispecific antibodies). Such FAP binding domains and related antibodies find use, for example, in the treatment of FAP associated cancers.

SUMMARY

Provided herein are novel FAP binding domains and antibodies (e.g., heterodimeric bispecific antibodies) that include such FAP binding domains. Subject antibodies that include such FAP binding domains advantageously elicit a range of different immune responses, depending on the particular FAP binding domain used. For example, the subject antibodies exhibit differences in selectivity for cells with different FAP expression, potencies for FAP expressing cells, ability to elicit cytokine release, and sensitivity to soluble FAP. Such FAP binding domains and related antibodies find use, for example, in the treatment of FAP associated cancers.

In a first aspect, provided herein is a composition that includes a fibroblast activation protein (FAP) binding domain. In one embodiment, the FAP binding domain includes the variable heavy complementary determining regions 1-3 (vhCDR1-3) and the variable light complementary determining regions (vlCDR1-3) of any of the following FAP binding domains: [αFAP]_H0.26_L0, [αFAP]_H0.26_L0.11, [αFAP]H0.26_L0.19, 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1. In some embodiments, the vhCDR1-3 and vlCDR1-3 are selected from the vhCDR1-3 and vlCDR1-3 sequences provided in FIGS. 14 and 45.

In an exemplary embodiment, the fibroblast activation protein (FAP) binding domain includes a variable heavy domain and a variable light domain of any of the following FAP binding domains: [αFAP]_H0.26_L0, [αFAP]_H0.26_L0.11, [αFAP]_H0.26_L0.19, 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1 (FIG. 14). In certain embodiments, the fibroblast activation protein (FAP) binding domain selected from the following FAP binding domains: 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1 (FIGS. 14 and 45).

In another aspect, provided herein is an antibody that includes a fibroblast activation protein (FAP) binding domain. In some embodiments, the FAP binding domain includes the variable heavy complementary determining regions 1-3 (vhCDR1-3) and the variable light complementary determining regions (vlCDR1-3) of any of the following FAP binding domains: [αFAP]_H0.26_L0, [αFAP]_H0.26_L0.11, [αFAP]_H0.26_L0.19, 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1. In certain embodiments, the antibody includes the vhCDR1-3 and vlCDR1-3 are selected from the vhCDR1-3 and vlCDR1-3 provided in FIGS. 14 and 45.

In some embodiments, the antibody includes a variable heavy domain and a variable light domain of any of the following FAP binding domains: [αFAP]_H0.26_L0, [αFAP]H0.26_L0.11, [αFAP]_H0.26_L0.19, 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1 (FIGS. 14 and 45). In an exemplary embodiment, the antibody includes a fibroblast activation protein (FAP) binding domain selected from the following FAP binding domains: 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1 (FIGS. 14 and 45).

In an exemplary embodiment, the antibody is an antibody that includes: a) a first monomer that includes a first antigen binding domain and a first constant domain; and b) a second monomer that includes a second antigen binding domain and a second constant domain, wherein either of the first antigen binding domain or second antigen binding domain is the FAP binding domain.

In certain embodiments, the first antigen binding domain and the second antigen binding domain bind different antigens. In some embodiments, the first antigen binding domain is the FAP binding domain and the second antigen binding domain is a CD3 binding domain. In an exemplary embodiment, the CD3 binding domain includes the vhCDR1-3, and vlCDR1-3 of any of the following CD3 binding domains: H1.30_L1.47, H1.32_L1.47; H1.89_L1.48; H1.90_L1.47; H1.33_L1.47; and H1.31_L1.47. In some embodiments, the vhCDR1-3 and vlCDR1-3 are selected from the vhCDR1-3 and vlCDR1-3 in FIG. 12. In some embodiments, the CD3 binding domain comprises the variable heavy domain and variable light domain of any of the following CD3 binding domains: H1.30_L1.47, H1.32_L1.47; H1.89_L1.48; H1.90_L1.47; H1.33_L1.47; and H1.31_L1.47.

In some embodiments of the subject antibody, the CD3 binding domain is an anti-CD3 scFv. In certain embodiments, the scFv includes a charged scFv linker.

In certain embodiments, the first and second constant domains each comprise CH2-CH3. In some embodiments, the first and second constant domains each comprise CH1-hinge-CH2-CH3.

In certain embodiments, the first and second constant domains each are a variant constant domain. In exemplary embodiments, the first and second monomers comprise a set of heterodimerization variants selected from the group consisting of those depicted in FIG. 3. In some embodiments, the set of heterodimerization variants selected is from the group consisting of S364K/E357Q:L368D/K370S; S364K:L368D/K370S; S364K:L368E/K370S; D401K: T411E/K360E/Q362E; and T366W:T366S/L368A/Y407V.

In some embodiments, the first and second monomers each further comprise an ablation variant. In an exemplary embodiment, the ablation variant is E233P/L234V/L235A/G236del/S267K.

In one embodiment, at least one of the first or second monomer further includes a pI variant. In some embodiments, the pI variant is N208D/Q295E/N384D/Q418E/N421D.

In another aspect, provided herein is an anti-FAP×anti-CD3 antibody having a "1+1 Fab-scFv-Fc" format. In some embodiments, the antibody includes a first monomer, a second monomer and a light chain. In certain embodiments, the first monomer includes: i) an anti-CD3 scFv that includes a first variable light domain, an scFv linker and a first variable heavy domain; and ii) a first Fc domain, where the scFv is covalently attached to the N-terminus of the first Fc domain using a domain linker. In some embodiments, the second monomer includes a VH2-CH1-hinge-CH2-CH3 monomer, wherein VH is a second variable heavy domain and CH2-CH3 is a second Fc domain. In some embodiments, the light chain includes a second variable light domain, where the second variable heavy domain and the second variable light domain form a FAP binding domain. In an exemplary embodiment, the scFv linker is a charged scFv linker.

In an exemplary embodiment, the anti-FAP×anti-CD3 "1+1 Fab-scFv-Fc" antibody includes a FAP binding domain having the vhCDR1-3 and vlCDR1-3 of any of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1. In some embodiments, the vhCDR1-3 and vlCDR1-3 are selected from the vhCDR1-3 and vlCDR1-3 sequences provided in FIGS. 14 and 45.

In an exemplary embodiment of the anti-FAP×anti-CD3 "1+1 Fab-scFv-Fc" antibody, the second heavy variable domain includes a heavy variable domain and the second light variable domain includes a variable light domain of any of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1.

In some embodiments, the anti-CD3 scFv of the anti-FAP×anti-CD3 "1+1 Fab-scFv-Fc" antibody includes the vhCDR1-3 and the vlCDR1-3 of any of the following CD3 binding domains: H1.30_L1.47, H1.32_L1.47; H1.89_L1.48; H1.90_L1.47; H1.33_L1.47; and H1.31_L1.47. In certain embodiments, the vhCDR1-3 and vlCDR1-3 are selected from the vhCDR1-3 and vlCDR1-3 in FIG. 12.

In some embodiments, the anti-CD3 scFv of the anti-FAP×anti-CD3 "1+1 Fab-scFv-Fc" antibody includes the variable heavy domain and variable light domain of any of the following CD3 binding domains: H1.30_L1.47, H1.32_L1.47; H1.89_L1.48; H1.90_L1.47; H1.33_L1.47; and H1.31_L1.47.

In certain embodiments of the anti-FAP×anti-CD3 "1+1 Fab-scFv-Fc" antibody, the first variable light domain is covalently attached to the N-terminus of the first Fc domain using a domain linker. In some embodiments, the first variable heavy domain is covalently attached to the N-terminus of the first Fc domain using a domain linker.

In certain embodiments of the anti-FAP×anti-CD3 "1+1 Fab-scFv-Fc" antibody, the first and second Fc domains are variant Fc domains.

In one embodiment, the first and second monomers include a set of heterodimerization variants selected from the group consisting of those depicted in FIG. 3.

In certain embodiments, the set of heterodimerization variants selected is from the group consisting of S364K/E357Q:L368D/K370S; S364K:L368D/K370S; S364K:L368E/K370S; D401K: T411E/K360E/Q362E; and T366W:T366S/L368A/Y407V, wherein the number is according to EU numbering. In an exemplary embodiment, the heterodimerization variant set is S364K/E357Q:L368D/K370S.

In one embodiment, the first and second monomers further include an ablation variant. In some embodiments, the ablation variant is E233P/L234V/L235A/G236del/S267K.

In certain embodiments of the anti-FAP×anti-CD3 "1+1 Fab-scFv-Fc" antibody, one of the first or second monomer includes a pI variant. In some embodiments, the pI variant is N208D/Q295E/N384D/Q418E/N421D, wherein the number is according to EU numbering.

In some embodiments of the anti-FAP×anti-CD3 "1+1 Fab-scFv-Fc" antibody, the first monomer includes amino acid variants S364K/E357Q/E233P/L234V/L235A/G236del/S267K, and the second monomer includes amino acid variants L368D/K370S/N208D/Q295E/N384D/Q418E/N421 D/E233P/L234V/L235A/G236del/S267 K, where the numbering is according to EU numbering. In particular embodiments, the scFv linker is a charged scFv linker has the amino acid sequence (GKPGS)$_4$. In an exemplary embodiment, the first and second monomers each further comprise amino acid variants 428/434S.

In exemplary embodiments of the anti-FAP×anti-CD3 "1+1 Fab-scFv-Fc" antibody, the antibody includes: a) a first monomer that includes from N-terminal to C-terminal, a scFv-linker-CH2-CH3, wherein scFv is an anti-CD3 scFV and CH2-CH3 is a first Fc domain; b) a second monomer that includes from N-terminal to C-terminal a VH-CH1-hinge-CH2-CH3, wherein CH2-CH3 is a second Fc domain; and c) a light chain that includes VL-CL. In such embodiments, the first variant Fc domain includes amino acid variants S364K/E357Q; the second variant Fc domain includes amino acid variants L368D/K370S; the first and second variant Fc domains each include amino acid variants E233P/L234V/L235A/G236del/S267K; the hinge-CH2-CH3 of the second monomer includes amino acid variants N208D/Q295E/N384D/Q418E/N421D, the VH and VL form a FAP binding domain that includes the variable heavy domain and the variable light domain, respectively, of a FAP binding domain selected from [αFAP]_H0.26_L0, [αFAP] H0.26_L0.11, [αFAP]_H0.26_L0.19, 1A7B5 H1_L1, 1E5A5 H1_L1, 1E5A5 (common light chain) H1_L1, and 1F4B5 H1_L1; the anti-CD3 scFv includes the variable heavy domain and the variable light domain of a CD3 binding domain selected from H1.30_L1.47, H1.32_L1.47, H1.89_L1.47, H1.90_L1.47, H1.33_L1.47, and H1.31_L1.47, and where numbering is according to EU numbering. In one embodiment, the anti-CD3 scFv includes the variable heavy domain and the variable light domain of H1.32_L1.47.

In another aspect, provided herein is an anti-FAP×anti-CD3 heterodimeric antibody having the "2+1 Fab2-scFv-Fc" format. In some embodiments, the antibody includes a first monomer, a second monomer and a common light chain. In some embodiments, the first monomer includes a VH1-CH1-linker1-scFv-linker2-CH2-CH3, where VH1 is a first variable heavy domain, scFv is an anti-CD3 scFV, linker 1 and linker 2 are a first domain linker and second domain linker, respectively, and CH2-CH3 is a first Fc domain. In some embodiments, the second monomer includes a VH2-CH1-hinge-CH2-CH3, wherein VH2 is a second variable heavy domain and CH2-CH3 is a second Fc domain. In certain embodiments, the common light chain includes a variable light domain. In such an anti-FAP×anti-CD3 heterodimeric antibody, the first variable heavy domain and the variable light domain form a first FAP binding domain, and the second variable heavy domain and the variable light domain form a second FAP binding domain.

In certain embodiments of the anti-FAP×anti-CD3 "2+1 Fab2-scFv-Fc" antibody, the first and second FAP binding domains each bind FAP and include the vhCDR1-3 and vlCDR1-3 of any of the following FAP binding domains: [αFAP]_H0.26_L0, [αFAP]H0.26_L0.11, [αFAP]_H0.26_L0.19, 1A7B5 H1_L1, 1E5A5 H1_L1, 1E5A5 (common light chain) H1_L1, and 1F4B5 H1_L1. In some embodiments, the vhCDR1-3 and vlCDR1-3 are selected from the vhCDR1-3 and vlCDR1-3 provided in FIGS. 14 and 45. In one embodiment, the first and second variable heavy domain each include a variable heavy domain of a FAP binding domain and the variable light domain includes the corresponding variable light domain of the FAP binding domain, where the FAP binding domain is any of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1.

In certain embodiments of the anti-FAP×anti-CD3 "2+1 Fab2-scFv-Fc" antibody, the scFv includes the vhCDR1-3 and the vlCDR1-3 of any of the following CD3 binding domains: H1.30_L1.47, H1.32_L1.47; H1.89_L1.48; H1.90_L1.47; H1.33_L1.47; and H1.31_L1.47. In some embodiments, the CD3 binding domain is H1.32_L1.47. In certain embodiments, the vhCDR1-3 and vlCDR1-3 are selected from the vhCDR1-3 and vlCDR1-3 in FIG. 12. In one embodiment, the scFv comprises the variable heavy domain and variable light domain of any of the following CD3 binding domains: H1.30_L1.47, H1.32_L1.47; H1.89_L1.48; H1.90_L1.47; H1.33_L1.47; and H1.31_L1.47. In some embodiments, the CD3 binding domain is H1.32_L1.47.

In certain embodiments of the anti-FAP×anti-CD3 "2+1 Fab2-scFv-Fc" antibody, the scFv includes an scFv variable heavy domain, an scFv variable light domain and an scFv linker that connects the scFv variable heavy domain and the scFv variable light domain. In some embodiments, the scFv variable heavy domain is attached to the C-terminus of the CH1 of the first monomer using the first domain linker and the scFv variable light domain is covalently attached to the N-terminus of the first Fc domain using the second domain linker. In one embodiment, the scFv variable light domain is attached to the C-terminus of the CH1 of the first monomer using the first domain linker and the scFv variable heavy domain is covalently attached to the N-terminus of the first Fc domain using the second domain linker. In some embodiments, the scFv linker is a charged scFv linker.

In certain embodiments of the anti-FAP×anti-CD3 "2+1 Fab2-scFv-Fc" antibody, the first and second Fc domains are variant Fc domains. In some embodiments, the first and second monomers include a set of heterodimerization variants selected from the group consisting of those depicted in FIG. 3. In one embodiment, the set of heterodimerization variants are selected from the group of: S364K/E357Q: L368D/K370S; S364K:L368D/K370S; S364K:L368E/K370S; D401K: T411E/K360E/Q362E; and T366W:T366S/L368A/Y407V, wherein the number is according to EU numbering. In an exemplary embodiment, the heterodimerization variant set is S364K/E357Q:L368D/K370S.

In certain embodiments of the anti-FAP×anti-CD3 "2+1 Fab2-scFv-Fc" antibody, the first and second monomers further include an ablation variant. In some embodiments, the ablation variant is E233P/L234V/L235A/G236del/S267K, wherein the number is according to EU numbering.

In certain embodiments of the anti-FAP×anti-CD3 "2+1 Fab2-scFv-Fc" antibody, one of the first or second monomer further includes a pI variant. In an exemplary embodiment, the pI variant is N208D/Q295E/N384D/Q418E/N421D. In certain embodiments of the anti-FAP×anti-CD3 "2+1 Fab2-scFv-Fc" antibody, the first monomer includes amino acid variants S364K/E357Q/E233P/L234V/L235A/G236del/S267K, and the second monomer includes amino acid variants L368D/K370S/N208D/Q295E/N384D/Q418E/N421 D/E233P/L234V/L235A/G236del/S267 K, wherein the number is according to EU numbering. In particular embodiments, the scFv linker is a charged scFv linker has the amino acid sequence (GKPGS)$_4$ (SEQ ID NO: 4). In an exemplary embodiment, the first and second monomers each further comprise amino acid variants 428/434S.

In exemplary embodiments of the anti-FAP×anti-CD3 "2+1 Fab2-scFv-Fc" antibody, the antibody includes: a) a first monomer that includes from N-terminal to C-terminal, a VH-CH1-linker 1-scFv-linker 2-CH2-CH3, wherein scFv is an anti-CD3 scFV and CH2-CH3 is a first Fc domain; b) a second monomer that includes from N-terminal to C-terminal a VH-CH1-hinge-CH2-CH3, wherein CH2-CH3 is a second Fc domain; and c) a common light chain that includes VL-CL. In such embodiments, the first variant Fc domain includes amino acid variants S364K/E357Q; the second variant Fc domain includes amino acid variants L368D/K370S; the first and second variant Fc domains each include amino acid variants E233P/L234V/L235A/G236del/ S267K; the hinge-CH2-CH3 of the second monomer includes amino acid variants N208D/Q295E/N384D/ Q418E/N421D, the VH and VL form a FAP binding domain that includes the variable heavy domain and the variable light domain, respectively, of a FAP binding domain selected from [αFAP]_H0.26_L0, [αFAP]H0.26_L0.11, [αFAP]_ H0.26_L0.19, 1A7B5 H1_L1, 1E5A5 H1_L1, 1E5A5 (common light chain) H1_L1, and 1F4B5 H1_L1; the anti-CD3 scFv includes the variable heavy domain and the variable light domain of a CD3 binding domain selected from H1.30_L1.47, H1.32_L1.47, H1.89_L1.47, H1.90_L1.47, H1.33_L1.47, and H1.31_L1.47, and where numbering is according to EU numbering. In particular embodiments, the scFv includes an scFv linker that is a charged scFv linker having the amino acid sequence (GKPGS)$_4$. In an exemplary embodiment, the first and second monomers each further comprise amino acid variants 428/434S. In one embodiment, the anti-CD3 scFv includes the variable heavy domain and the variable light domain of H1.32_L1.47.

In exemplary embodiments of the anti-FAP×anti-CD3 "2+1 Fab2-scFv-Fc" antibody, the antibody is selected from the following antibodies: XENP25393, XENP29140, XENP28115, XENP29141, XENP28116, XENP29142, XENP25193, XENP25194, XENP25195, XENP25967, XENC1145, XENC1123, XENC1079, and XENC1101.

In another aspect, provided herein is a heterodimeric antibody selected from the following heterodimeric antibodies described herein: XENP024704, XENP024707, XENP024708, XENP024710, XENP024712, XENP024713, XENP024715, XENP024802, XENP025384, XENP025965, XENP025185, XENP025186, XENP025187, XENP025188, XENP025189, XENP025191, XENP025192, XENP025193, XENP025194, XENP025195, XENP025196, XENP025966, XENP025967.

In another aspect provided herein is a nucleic acid composition that includes nucleic acids encoding the antibodies and binding domains described herein, expression vectors that include the nucleic acids, host cells transformed with the expression vectors. Also provided herein are methods of making such antibodies by culturing any host cell described herein under conditions wherein the antibody is expressed, and recovering the antibody.

In another aspect, provided herein is a method of treating a cancer by administering to a patient in need thereof any of the subject antibodies described herein.

BRIEF DESCRIPTION OF THE DRAWINGS

FIGS. 1A to 1K depict several formats for use in the anti-CD3×anti-FAP bispecific antibodies disclosed herein. The first is the "1+1 Fab-scFv-Fc" format (also referred to as the "bottle opener" or "Triple F" format), with a first antigen binding domain that is a Fab domain and a second anti-antigen binding domain that is an scFv domain (FIG. 1A). Additionally, "mAb-Fv," "mAb-scFv," "2+1 Fab2-scFv-Fc" (also referred to as the "central scFv" or "central-scFv" format"), "central-Fv," "one armed central-scFv," "one scFv-mAb," "scFv-mAb," "dual scFv," "trident," and non-heterodimeric bispecific formats are all shown. The scFv domains depicted in FIG. 1 can be either N- to C-terminus variable heavy-(optional linker)-variable light, or variable light-(optional linker)-variable heavy. In addition, for the one armed scFv-mAb, the scFv can be attached either to the N-terminus of a heavy chain monomer or to the N-terminus of the light chain. In certain embodiments, "Anti-antigen 1" in FIG. 1 refers to a FAP binding domain. In certain embodiments, "Anti-antigen 1" in FIG. 1 refers to a CD3 binding domain. In certain embodiments, "Anti-antigen 2" in FIG. 1 refers to a FAP binding domain. In certain embodiments "Anti-antigen 2" in FIG. 1 refers to a CD3 binding domain. In some embodiments, "Anti-antigen 1" in FIG. 1 refers to a FAP binding domain and "Anti-antigen 2" in FIG. 1 refers to a CD3 binding domain. In some embodiments, "Anti-antigen 1" in FIG. 1 refers to a CD3 binding domain and "Anti-antigen 2" in FIG. 1 refers to a FAP binding domain. Any of the FAP binding domains and CD3 binding domains disclosed can be included in the bispecific formats of FIG. 1.

FIG. 2 depicts the sequences for A) human, B) mouse, and C) cynomolgus FAP (predicted). Such FAPs were used for the development of FAP antigen binding domains that are cross-reactive for ease of clinical development.

FIG. 3A-3F depict useful pairs of heterodimerization variant sets (including skew and pI variants). In FIG. 3F, there are variants for which there are no corresponding "monomer 2" variants. Such variants are pI variants that can be used alone on either monomer of a bispecific antibody, or included, for example, on the Fab side of a "1+1 Fab-scFv-Fc" format antibody and an appropriate charged scFv linker can be used on the second monomer that utilizes a scFv as the second antigen binding domain. Suitable charged linkers are shown in FIGS. 7A and B.

FIG. 4 depicts a list of isosteric variant antibody constant regions and their respective substitutions. pI_(−) indicates lower pI variants, while pI_(+) indicates higher pI variants. These variants can be optionally and independently combined with other variants, including heterodimerization variants, outlined herein.

FIG. 5 depict useful ablation variants that ablate FcγR binding (also referred to as "knockouts" or "KO" variants). In some embodiments, such ablation variants are included in the Fc domain of both monomers of the subject antibody described herein. In other embodiments, the ablation variants are only included on only one variant Fc domain.

FIG. 6 show two particularly useful embodiments of the heterodimeric antibodies disclosed herein, including various amino acid substitutions included in the "scFv monomer" and "Fab monomer" of the various "1+1 Fab-scFv-Fc" format and "2+1 Fab2-scFv-Fc" format antibodies disclosed herein. As described, for example, in Example 2 herein, FAP×CD3 bispecific antibodies having the "2+1 Fab2-scFv-Fc" format are potent in inducing redirected T cell cytotoxicity in cellular environments that express low levels of FAP.

FIG. 7 depicts a number of charged scFv linkers that find use in increasing or decreasing the pI of the subject heterodimeric antibodies that utilize one or more scFv as a component, as described herein. The (+H) positive linker finds particular use herein, particularly with anti-CD3 vl and vh sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include one or more scFvs (e.g., 1+1 Fab-scFv-Fc" format and "2+1 Fab2-scFv-Fc" format)

FIG. 8 depicts various heterodimeric skewing variant amino acid substitutions that can be used with the heterodimeric antibodies described herein.

FIGS. 9A-9D depicts the sequences of several useful "1+1 Fab-scFv-Fc" bispecific antibody format heavy chain backbones based on human IgG1, without the Fv sequences (e.g. the scFv and the VH for the Fab side). That is, the "/" slash at the beginning of the "Fab-Fc side" indicates that the C-terminus of a VH as outlined herein is attached at that point. Similarly, "/" slash at the beginning of the "scFv-Fc side" indicates that the C-terminus of a scFv (e.g., from N terminus to C terminus, VH-scFv linker-VL or VL-scFv linker-VH) as outlined herein is attached at that point.

As disclosed herein, the "1+1 Fab-scFv-Fc" bispecific antibody format includes a) a first monomer that includes a VH1-CH1-hinge-CH2-CH3; b) a second monomer that includes a scFv-linker-CH2-CH3; and c) a light chain. In FIG. 9, the "Fab-Fc Side" of each backbone sequence refers to the CH1-hinge-CH2-CH3 of the first monomer and the "scFv-Fc Side" sequence refers to the linker-CH2-CH3 of the second monomer.

Figure 1A:
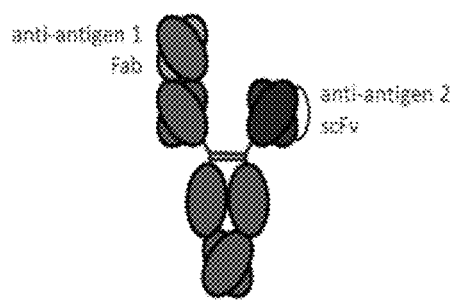

Backbone 1 is based on human IgG1 (356E/358M allotype), and includes the S364K/E357Q:L368D/K370S skew variants, C220S on the monomer with the S364K/E357Q skew variants, the N208D/Q295E/N384D/Q418E/N421D pI variants on the monomer with L368D/K370S skew variants and the E233P/L234V/L235A/G236del/S267K ablation variants on both first and second monomers. Backbone 2 is based on human IgG1 (356E/358M allotype), and includes S364K:L368D/K370S skew variants, C220S on the monomer with the S364K skew variant, the N208D/Q295E/N384D/Q418E/N421D pI variants on the monomer with the L368D/K370S skew variants, and the E233P/L234V/L235A/G236del/S267K ablation variants on both monomers. Backbone 3 is based on human IgG1 (356E/358M allotype), and includes S364K:L368E/K370S skew variants, C220S on the monomer with the S364K skew variant, the N208D/Q295E/N384D/Q418E/N421D pI variants on the monomer with L368E/K370S skew variants and the E233P/L234V/L235A/G236del/S267K ablation variants on both first and second monomers. Backbone 4 is based on human IgG1 (356E/358M allotype), and includes D401K: K360E/Q362E/T411E skew variants, C220S on the monomer with the D401K skew variant, the N208D/Q295E/N384D/Q418E/N421D pI variants on the monomer with K360E/Q362E/T411E skew variants and the E233P/L234V/L235A/G236del/S267K ablation variants on both first and second monomers. Backbone 5 is based on human IgG1 (356D/358L allotype), and includes S364K/E357Q:L368D/K370S skew variants, C220S on the monomer with the S364K/E357Q skew variants, the N208D/Q295E/N384D/Q418E/N421D pI variants on the monomer with L368D/K370S skew variants and the E233P/L234V/L235A/G236del/S267K ablation variants on both chains. Backbone 6 is based on human IgG1 (356E/358M allotype), and includes S364K/E357Q:L368D/K370S skew variants, C220S on the chain with the S364K/E357Q skew variants, N208D/Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to Backbone 6 except the N297A substitution is replaced with a N297S substitution. Backbone 8 is based on human IgG4, and includes the S364K/E357Q:L368D/K370S skew variants, the N208D/Q295E/N384D/Q418E/N421D pI variants on the monomer with L368D/K370S skew variants, as well as a S228P (EU numbering, S241P in Kabat) variant on both monomers that ablates Fab arm exchange as is known in the art. Backbone 9 is based on human IgG2, and includes the S364K/E357Q:L368D/K370S skew variants, the N208D/Q295E/N384D/Q418E/N421D pI variants on the monomer with L368D/K370S skew variants. Backbone 10 is based on human IgG2, and includes the S364K/E357Q:L368D/K370S skew variants, the N208D/Q295E/N384D/Q418E/N421D pI variants on the monomer with the L368D/K370S skew variants as well as a S267K variant on both first and second monomers. Backbone 11 is identical to Backbone 1, except it includes M428L/N434S Xtend mutations on both monomers. Backbone 12 is based on human IgG1 (356E/358M allotype), and includes S364K/E357Q:L368D/K370S skew variants, C220S and the P217R/P229R/N276K pI variants on the monomer with S364K/E357Q skew variants and the E233P/L234V/L235A/G236del/S267K ablation variants on both monomers.

In certain embodiments, the heterodimeric antibody includes a first monomer with a "Backbone 1" sequence and a second monomer with a corresponding "Backbone 2" sequence, wherein the "Backbone 1" and "Backbone 2" sequences are 90, 95, 98 and 99% identical (as defined herein) to any of the recited "Backbone 1" and "Backbone 2" sequences in FIGS. 9A-D. In some embodiments, the "Backbone 1" and "Backbone 2" sequences of the heterodimeric antibody include 1, 2, 3, 4, 5, 6, 7, 8, 9 or 10 additional amino acid substitutions as compared to anyone of the recited "Backbone 1" and "Backbone 2" sequences in FIGS. 9A-D, which, as will be appreciated by those in the art, already contain a number of amino acid modifications as compared to the parental human IgG1 (or IgG2 or IgG4, depending on the particular backbone sequences). That is, in some embodiments, the heterodimeric antibody includes backbone sequences that include additional amino acid modifications (e.g., amino acid substitutions) in addition to the skew, pI and ablation variants contained within the backbones of FIGS. 9A-D.

As will be appreciated by those in the art and outlined below, these backbone sequences can be used with any VH and VL pairs outlined herein, including for example, VH and VL pairs of any of the FAP binding domains and CD3 binding domains (e.g., anti-CD3 scFv) described herein. In certain embodiments, the antibody includes a) a FAP binding domain VH (e.g., any of the FAP binding domains described herein) attached to the "Fab-Fc Side" (first monomer); b) an anti-CD3 scFv (e.g., any of the anti-CD3 scFvs described herein) is attached to the "scFv-Fc Side" (second monomer); and c) the corresponding VL of the FAP binding domain.

FIGS. 10A-10C depict the sequences of several useful "2+1 Fab2-scFv-Fc" (also referred to as the "central-scFv") bispecific antibody format monomer backbones based on human IgG1, without the sequences of the Fvs and linkers. Thus, for example, on the "Fab-Fc side", the (VH domain/" indicates that the C-terminus of a VH domain is attached at that location, which is the beginning of the CH1 domain of a heavy chain. Similarly, the "VH-CH1-domain linker 1-scFv-domain linker 2/" at the beginning of the "Fab-scFv-Fc side" indicates that these sequences are attached to the recited sequence, which is the variant CH2-CH3 Fc domain. As discussed herein, the scFv domain can be in either orientation, -VH-scFv linker-VL- or -VL-scFv linker-VH- (from N-terminus to C-terminus) as discussed herein. Additionally, in some embodiments of the subject 2+1 Fab2-scFv-Fc "domain linker 2" is one of the "useful domain linkers" in FIG. 7. Note that the sequence identifiers are only to the recited sequences.

As described herein, the central-scFv bispecific antibody format includes a) a first monomer that includes a VH1-CH1-hinge-CH2-CH3 (the "Fab-Fc side"); b) a second monomer that includes a VH1-CH1-hinge-(optional linker 1)-scFv-(optional linker 2)-CH2-CH3 (the "Fab-scFv-Fc side"); and c) a common light chain. In FIGS. 10A-C, the "Fab-Fc Side" of each backbone refers to the CH1-hinge-CH2-CH3 of the first monomer and the "Fab-scFv-Fc Side" refers to the CH2-CH3 amino of the second monomer.

Backbone 1 is based on human IgG1 (356E/358M allotype), and includes the S364K/E357Q:L368D/K370S skew variants, the N208D/Q295E/N384D/Q418E/N421D pI variants on the monomer with L368D/K370S skew variants and the E233P/L234V/L235A/G236del/S267K ablation variants on both monomers. Backbone 2 is based on human IgG1 (356E/358M allotype), and includes S364K:L368D/K370S skew variants, the N208D/Q295E/N384D/Q418E/N421D pI variants on the monomer with L368D/K370S skew variants, and the E233P/L234V/L235A/G236del/S267K ablation variants on both monomers. Backbone 3 is based on human IgG1 (356E/358M allotype), and includes S364K:L368E/K370S skew variants, the N208D/Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes D401K:K360E/Q362E/T411E skew variants, the N208D/Q295E/N384D/Q418E/N421D pI variants on the monomer with K360E/Q362E/T411E skew variants and the E233P/L234V/L235A/G236del/S267K ablation variants on both chains. Backbone 5 is based on human IgG1 (356D/358L allotype), and includes S364K/E357Q:L368D/K370S skew variants, the N208D/Q295E/N384D/Q418E/N421D pI variants on the chain with L368D/K370S skew variants and the E233P/L234V/L235A/G236del/S267K ablation variants on both monomers.

Backbone 6 is based on human IgG1 (356E/358M allotype), and includes S364K/E357Q:L368D/K370S skew variants, N208D/Q295E/N384D/Q418E/N421D pI variants on the monomer with L368D/K370S skew variants and the E233P/L234V/L235A/G236del/S267K ablation variants on both chains, as well as an N297A variant on both monomers. Backbone 7 is identical to 6 except the mutation is N297S. Backbone 8 is identical to backbone 1, except it includes M428L/N434S Xtend mutations. Backbone 9 is based on human IgG1 (356E/358M allotype), and includes S364K/E357Q:L368D/K370S skew variants, the P217R/P229R/N276K pI variants on the chain with S364K/E357Q skew variants and the E233P/L234V/L235A/G236del/S267K ablation variants on both monomers. In certain embodiments, the 2+1 Fab2-scFv-Fc format antibody includes one or more backbone sequences that are 90, 95, 98 and 99% identical (as defined herein) to the recited sequences in FIGS. 10A-C, and/or contain from 1, 2, 3, 4, 5, 6, 7, 8, 9 or 10 additional amino acid substitutions as compared to a backbone sequence. As will be appreciated by those in the art, the backbone sequences in FIGS. 10A-C already contain a number of amino acid modifications as compared to the parental human IgG1 (or IgG2 or IgG4, depending on the backbone). That is, in some embodiments, the recited backbones may contain additional amino acid modifications (generally amino acid substitutions) in addition to the skew, pI and ablation variants contained within the backbones of this figure.

As will be appreciated by those in the art and outlined below, these backbone sequences can be used with any VH and VL pairs outlined herein, including for example, VH and VL pairs of any of the FAP binding domains and CD3 binding domains (e.g., anti-CD3 scFv) described herein. In certain embodiments, an anti-FAP Fab is attached to the "Fab-Fc Side" and an anti-FAP Fab and an anti-CD3 scFv (e.g., any of the anti-CD3 scFvs described herein) is attached to the "scFv-Fc Side".

FIG. 11 depicts the "non-Fv" backbone of cognate light chains (i.e. constant light chain) which find use in the subject 1+1 Fab-scFv-Fc and 2+1 Fab2-scFv-Fc bispecific antibodies described herein.

FIGS. 12A-12F depict sequences for exemplary anti-CD3 scFvs suitable for use in the bispecific antibodies of the invention. The CDRs are underlined, the scFv linker is double underlined (in the sequences, the scFv linker is a positively charged scFv (GKPGS)$_4$ linker (SEQ ID NO: 4), although as will be appreciated by those in the art, this linker can be replaced by other linkers, including uncharged or negatively charged linkers, some of which are depicted in FIG. 7, and the slashes indicate the border(s) of the variable domains. In addition, the naming convention illustrates the orientation of the scFv from N- to C-terminus. As shown in FIG. 7, the scFv can be oriented as VH-scFv linker-VL (from N- to C-terminus) or as VL-scFv linker-VH (from N- to C-terminus). As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 13 depicts sequences for prototype anti-FAP antibodies with variable regions from prior art anti-FAP antibodies such as sibrotuzumab (see, e.g., U.S. Pat. No. 6,455,677, issued Sep. 24, 2002), and 29B11 and 3F2 (see, e.g., WO 2012/020006, published Feb. 16, 2012) with an ablation variant (E233P/L234V/L235A/G236del/S267K, "IgG1_PVA/S267K"). The CDRs are underlined.

As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems.

FIGS. 14A-14N depict the amino acid sequences of exemplary subject FAP antigen binding domains described herein. Sequences depicted include variable heavy (vh) domains and variable light (vl) domain sequences for each antigen binding domain. For each anti-FAP vh sequence, vhCDRs1-3 are underlined. For each anti-FAP VL sequence, vlCDRs1-3 are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the vh and vl domains using other numbering systems. Furthermore, as for all the sequences in the Figures, these vh and vl sequences can be used either in a scFv format or in a Fab format. In some embodiments, the FAP binding domains depicted in FIG. 13 find particular use in bispecific anti-CD3×anti-FAP antibodies disclosed herein, including such bispecific antibodies that are of the "1+1 Fab-scFv-Fc" and "2+1 Fab2-scFv-Fc" formats.

FIGS. 15A-15D depict amino acid sequences for exemplary anti-FAP antibodies with phage-derived variable regions with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems.

Figure 16A:
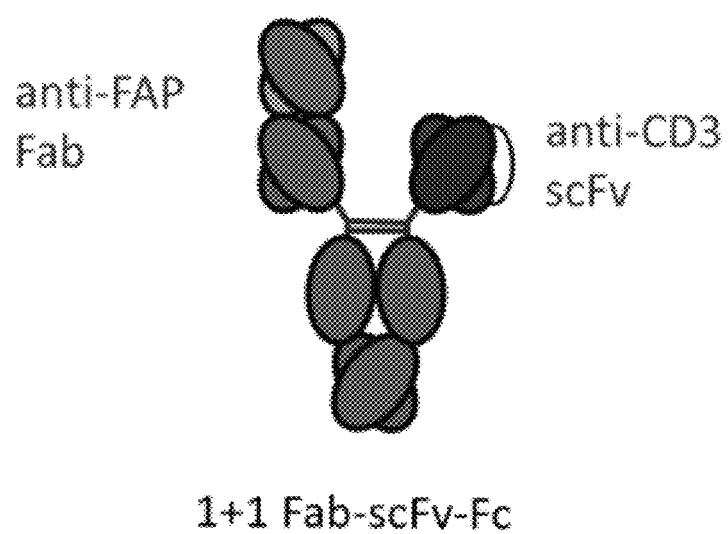
Figure 16B:
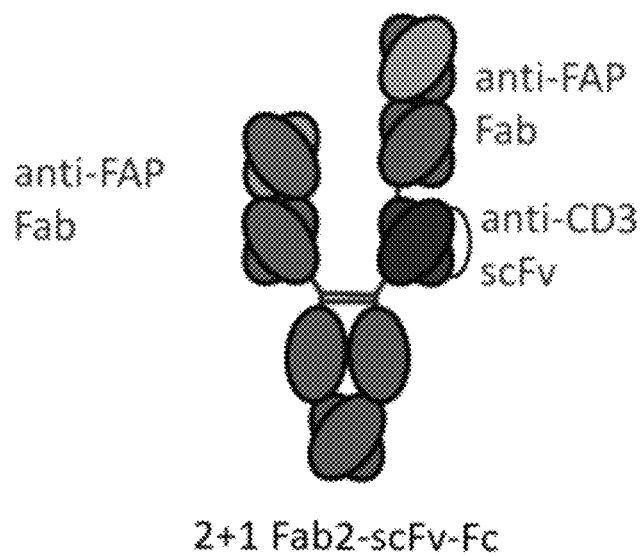

FIG. 16A-16B depicts several exemplary anti-FAP×anti-CD3 bispecific antibodies described herein. FIG. 16A depicts the "1+1 Fab-scFv-Fc" or "bottle-opener" format, with a first Fab arm binding FAP and a second scFv arm binding CD3. FIG. 16B depicts the 2+1 Fab2-scFv-Fc" or "central-scFv" format, with a first Fab arm binding FAP and a second Fab-scFv arm, wherein the Fab binds FAP and the scFv binds CD3.

FIGS. 17A-17E depicts the amino acid sequences of prototype anti-FAP×anti-CD3 bispecific antibodies in the bottle-opener format (Fab-scFv-Fc). The antibodies are named using the Fab variable region first and the scFv variable region second, separated by a dash. CDRs are underlined and slashes indicate the border(s) of the variable regions. The scFv domain has orientation (N- to C-terminus) of VH-scFv linker-VL, although this can be reversed. In addition, each sequence outlined herein can include or exclude the M428L/N434S variants in one or preferably both Fc domains, which results in longer half-life in serum.

FIGS. 18A-18D depict the amino acid sequences of prototype anti-FAP×anti-CD3 bispecific antibodies in the 2+1 Fab2-scFv-Fc format ("central scFv"). The antibodies are named using the Fab variable region first and the Fab-scFv variable regions second, separated by a dash. CDRs are underlined and slashes indicate the border(s) of the variable regions. The scFv domain has orientation (N- to C-terminus) of VH-scFv linker-VL, although this can be reversed in particular embodiments (i.e., VL-scFv linker-VH). In addition, each sequence outlined herein can include or exclude the M428L/N434S variants in one or preferably both Fc domains, which results in longer half-life in serum.

FIG. 19 depicts the amino acid sequences of a control anti-RSV×anti-CD3 bispecific antibodies in the 1+1 Fab-scFv-Fc ("bottle opener) format. The antibody is named using the Fab variable region first and the scFv variable region second, separated by a dash. CDRs are underlined and slashes indicate the border(s) of the variable regions. The scFv domain has orientation (N- to C-terminus) of VH-scFv linker-VL, although this can be reversed. In addition, each sequence outlined herein can include or exclude the M428L/N434S variants in one or preferably both Fc domains, which results in longer half-life in serum.

FIGS. 20A-20G depicts the amino acid sequences of exemplary anti-FAP×anti-CD3 bispecific antibodies with phage-derived variable regions in the 1+1 Fab-scFv-Fc ("bottle opener) format. The antibodies are named using the Fab variable region first and the scFv variable region second, separated by a dash. CDRs are underlined and slashes indicate the border(s) of the variable regions. The scFv domain has orientation (N- to C-terminus) of VH-scFv linker-VL, although this can be reversed. In addition, each sequence outlined herein can include or exclude the M428L/N434S variants in one or preferably both Fc domains, which results in longer half-life in serum.

FIGS. 21A-21J depict the amino acid sequences of anti-FAP×anti-CD3 bispecific antibodies with phage-derived variable regions in the 2+1 Fab2-scFv-Fc format ("central scFv"). The antibodies are named using the Fab variable region first and the Fab-scFv variable regions second, separated by a dash. CDRs are underlined and slashes indicate the border(s) of the variable regions. The scFv domain has orientation (N- to C-terminus) of VH-scFv linker-VL, although this can be reversed. In addition, each sequence outlined herein can include or exclude the M428L/N434S variants in one or preferably both Fc domains, which results in longer half-life in serum.

FIG. 22 depicts the sequence for human DPP4.

Figure 23:
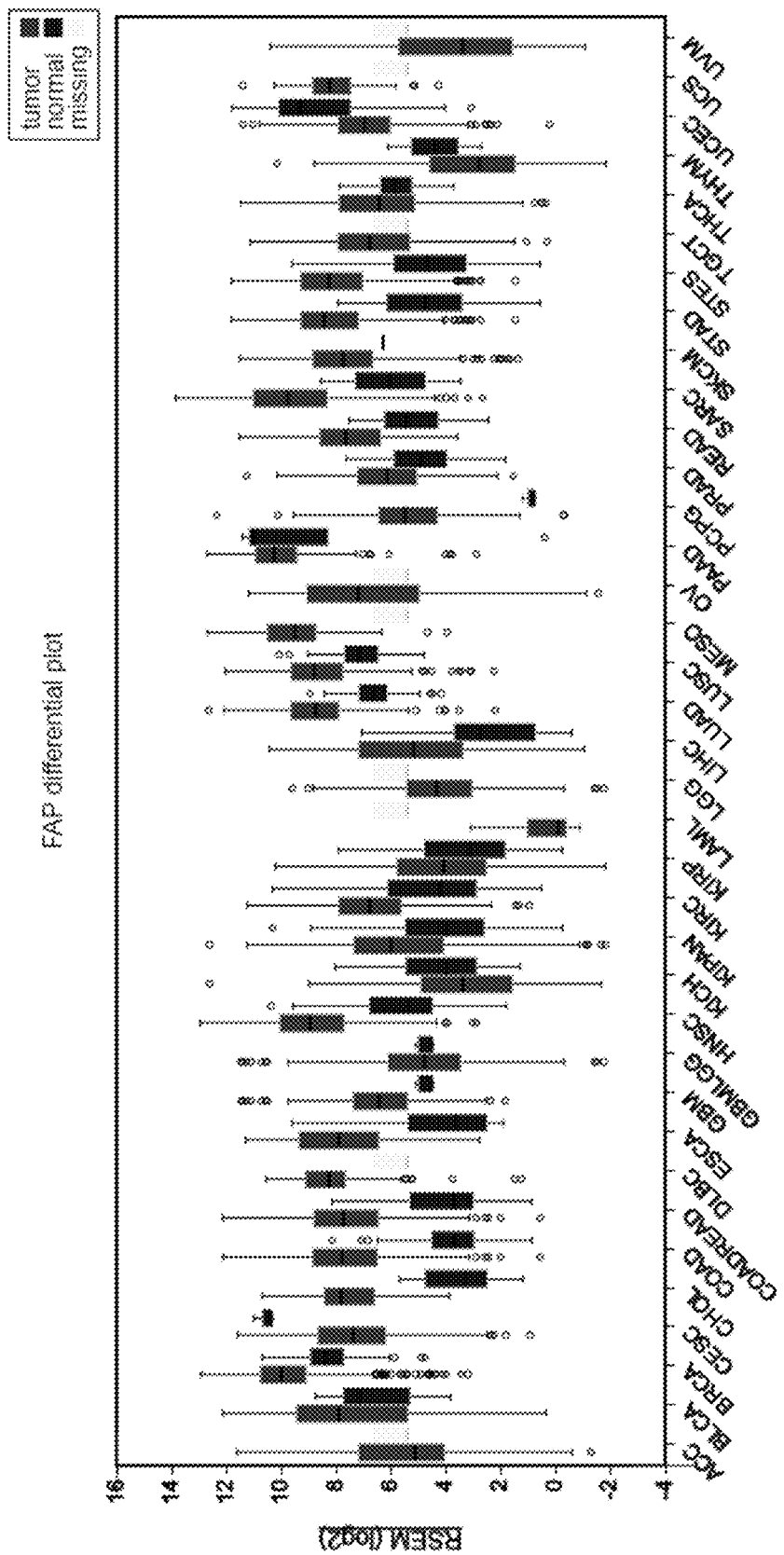

FIG. 23 depicts RNA transcription levels (RNAseq V2 RSEM) for FAP on tumors versus matched-normal tissue associated with various cancers as compiled from The Cancer Genome Atlas (TCGA).

Figure 24:
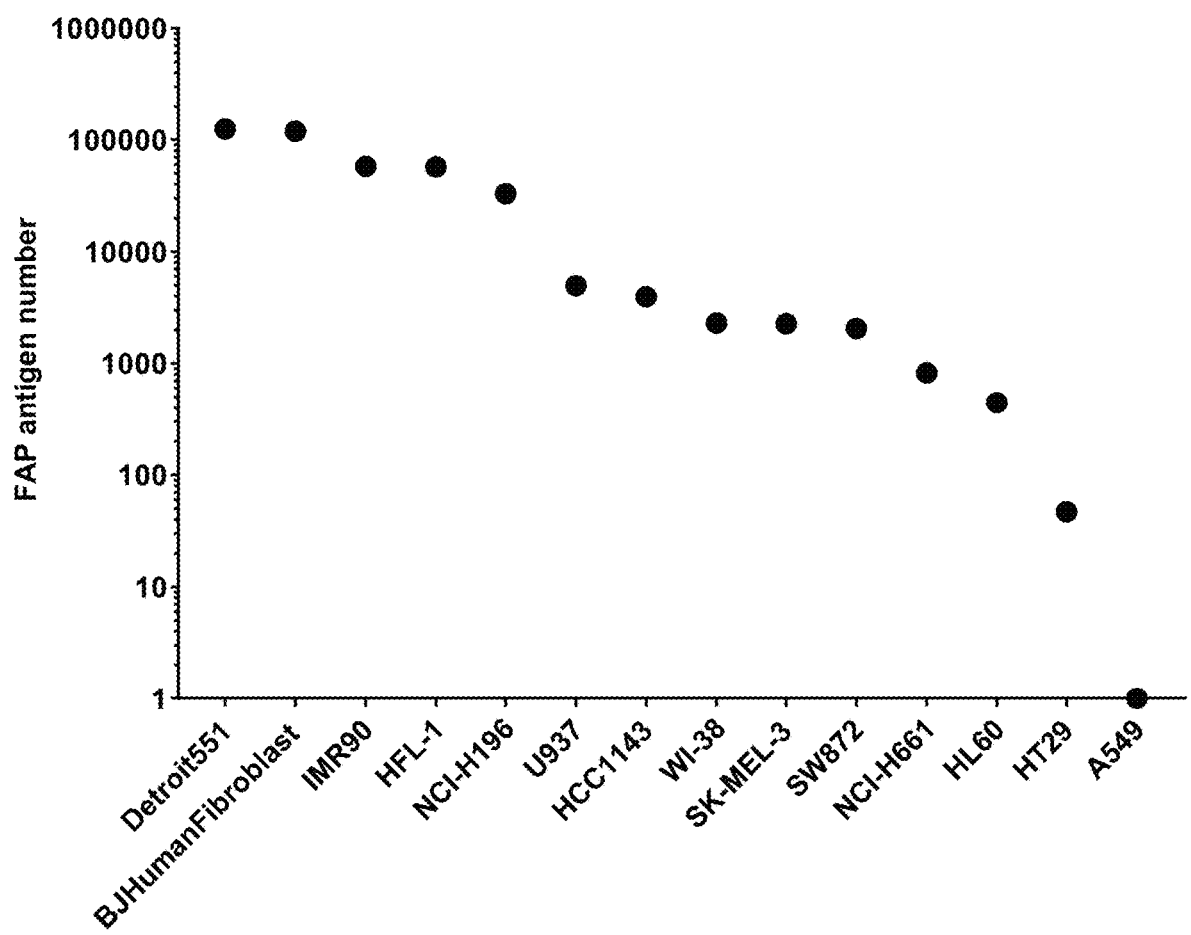

FIG. 24 depicts FAP antigen number on Detroit551, BJ human fibroblast, IMR90, HFL-1, HCI-H196, U937, HCC1143, WI-38, SK-MEL-3, NCI-H661, HL60, HT29, and A549 cell lines.

Figure 25:
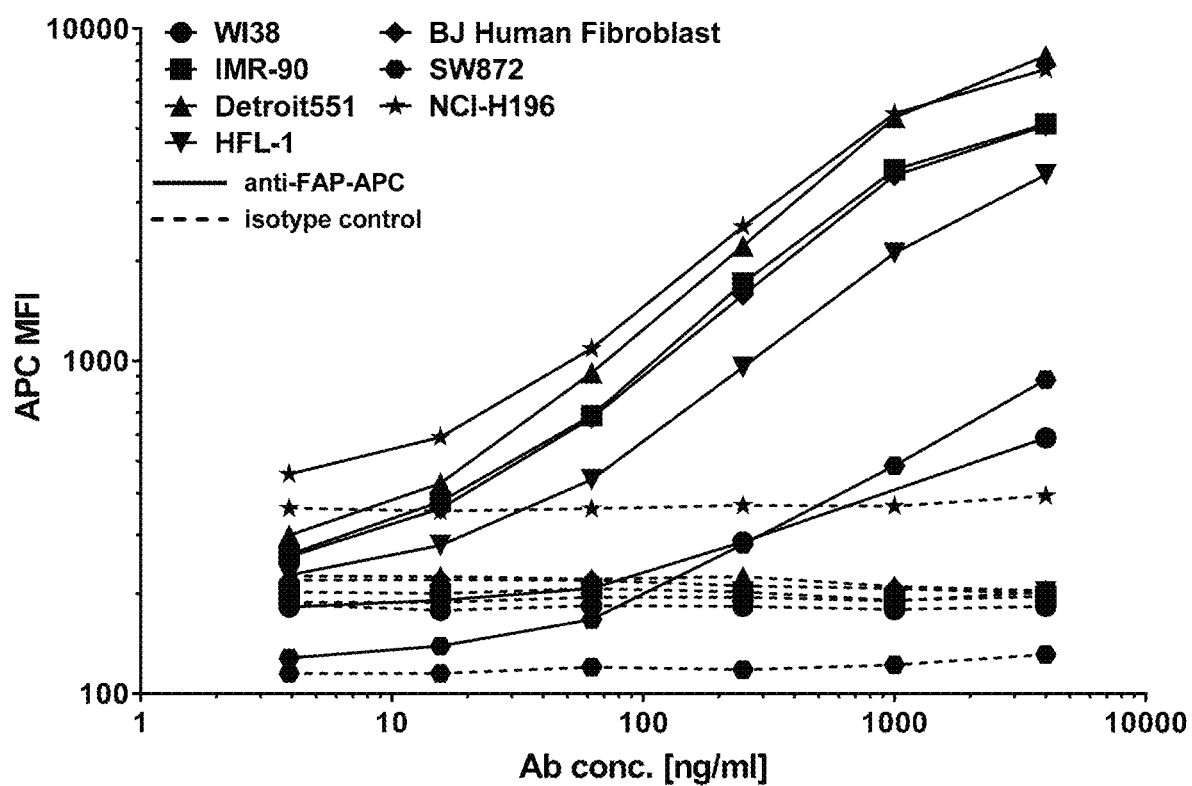

FIG. 25 depicts the binding of anti-FAP mAb (solid line) and anti-mouse IgG isotype control (dotted line) to WI-38, IMR-90, Detroit551, HFL-1, HFL-1, BJ human fibroblast, SW872 and NCI-H196 cell lines as indicated by APC MFI.

Figure 26:
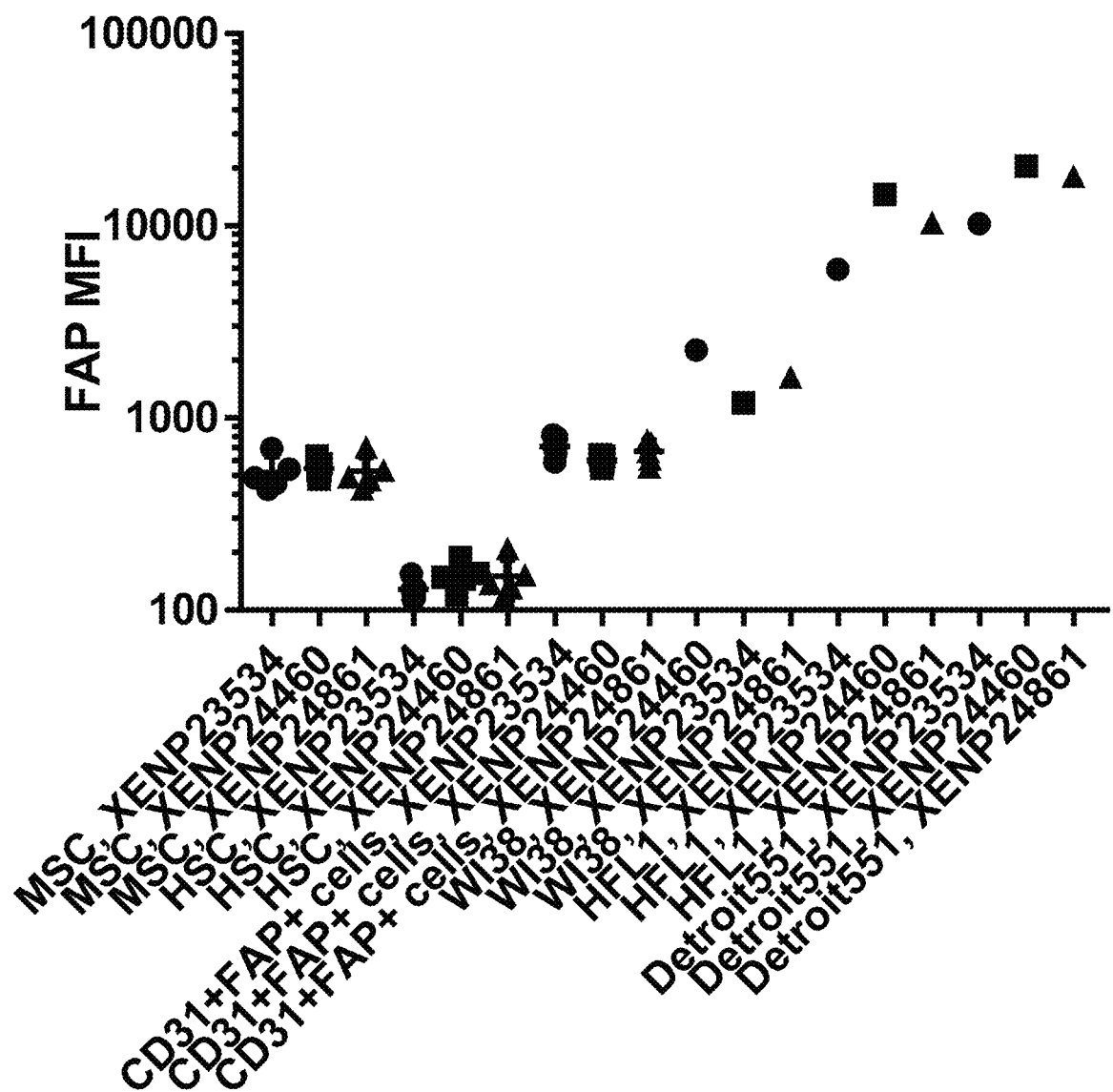
Figure 28A:
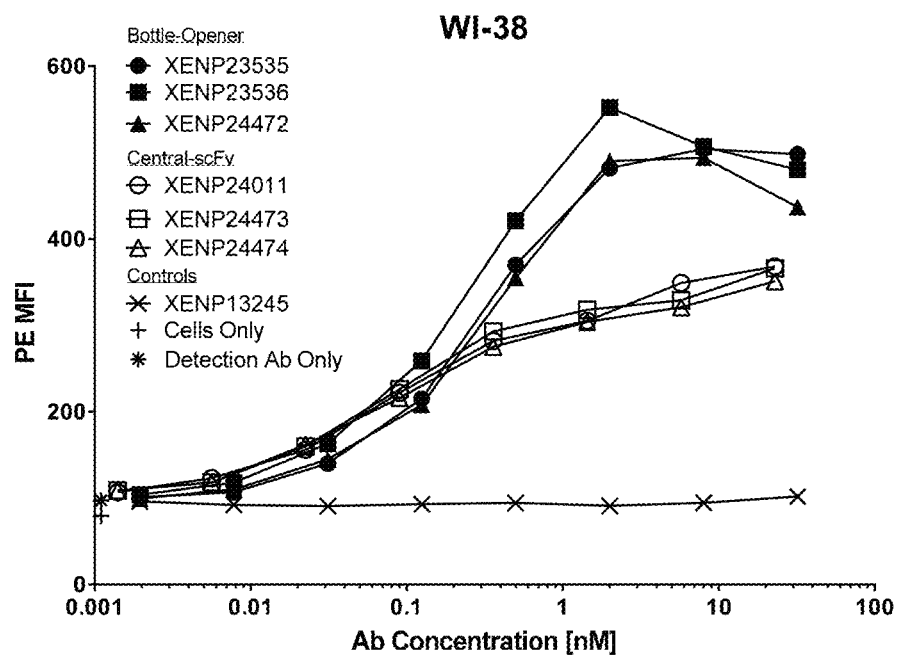
Figure 28B:
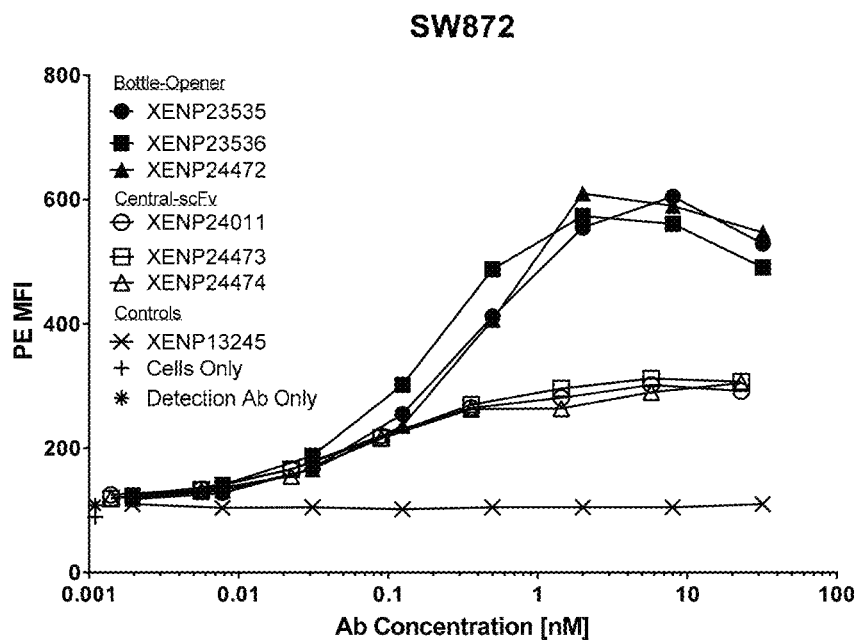
Figure 28C:
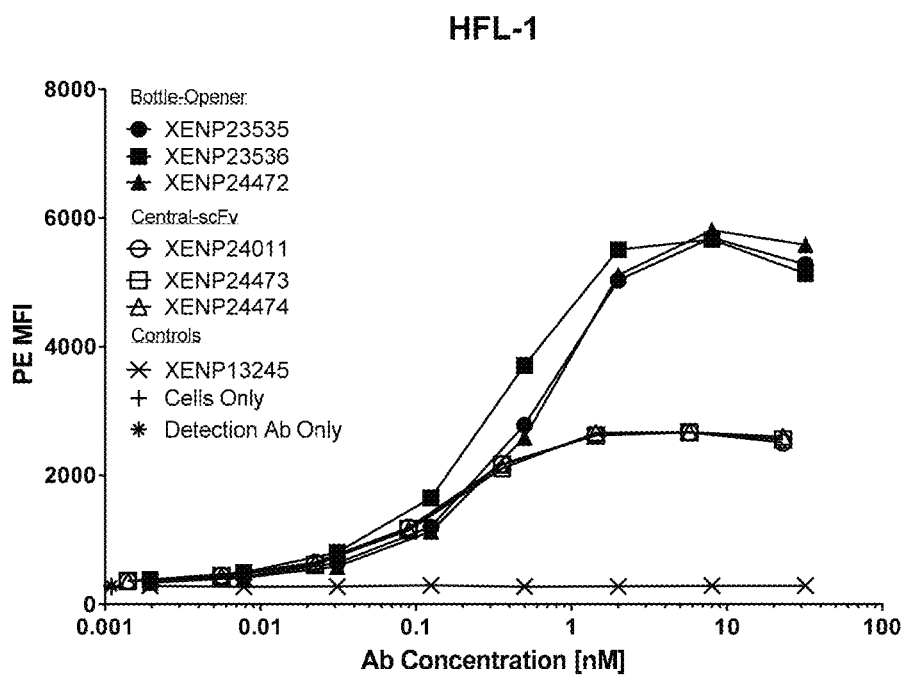
Figure 28D:
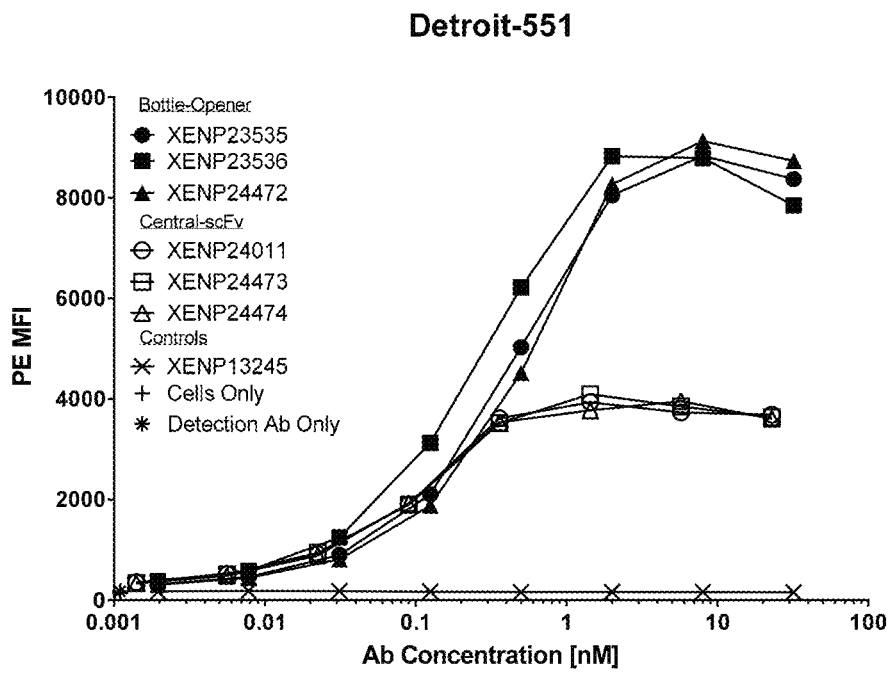
Figure 30A:
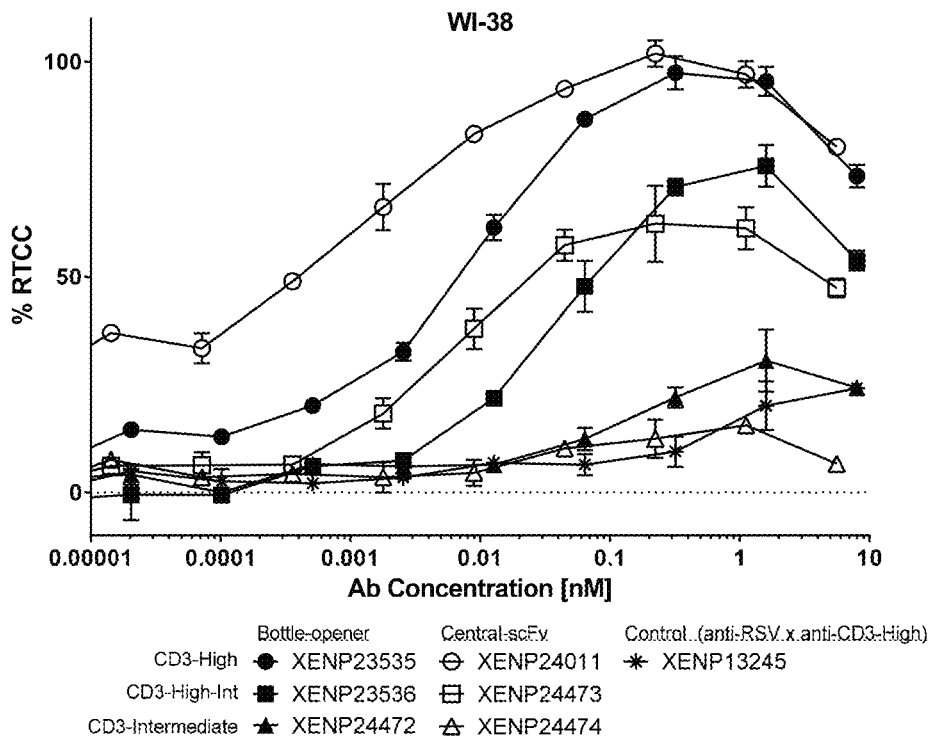
Figure 30B:
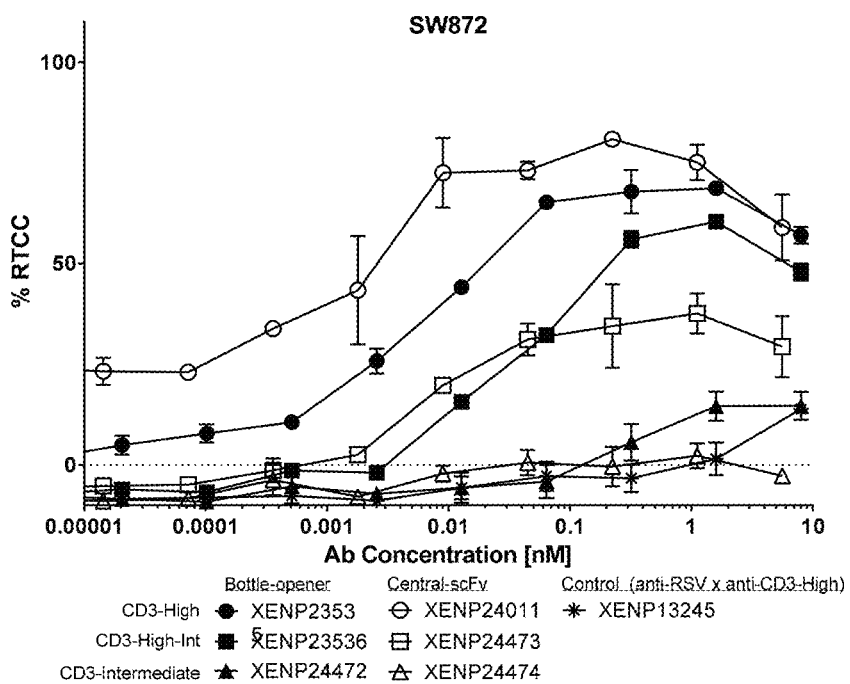
Figure 30C:
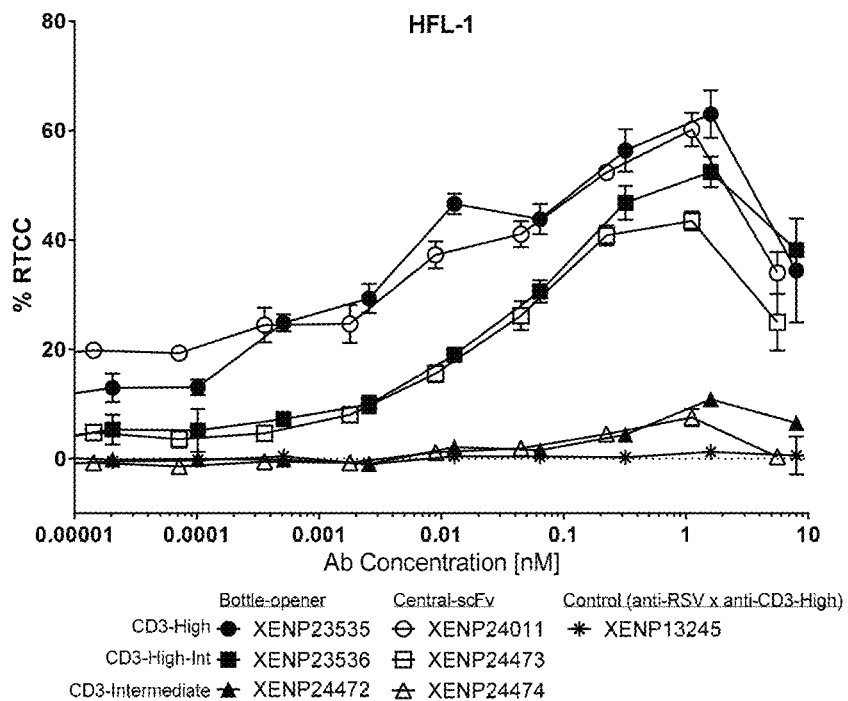
Figure 30D:
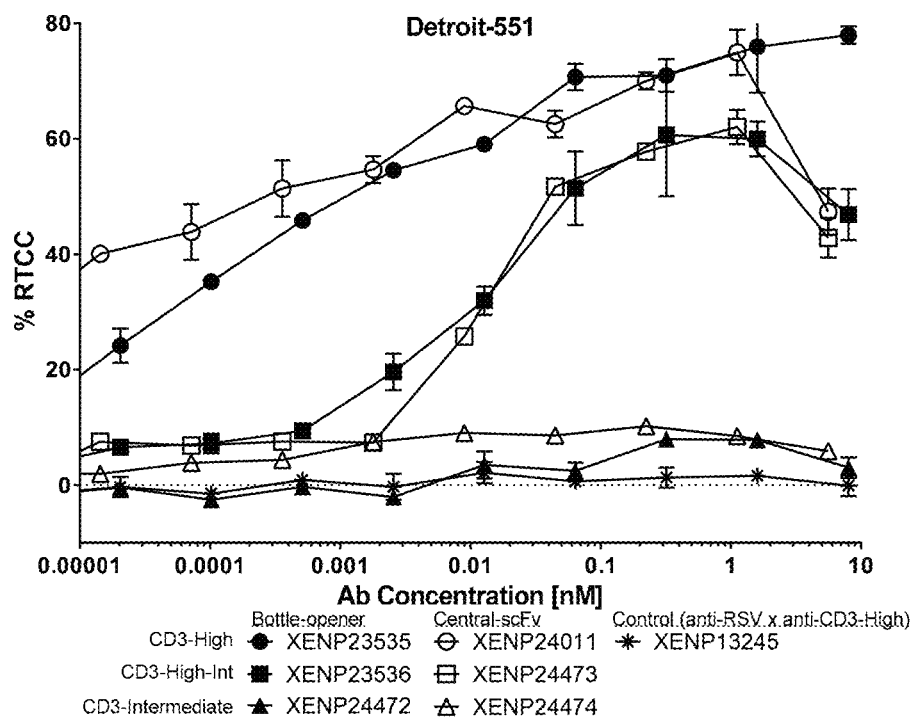
Figure 31A:
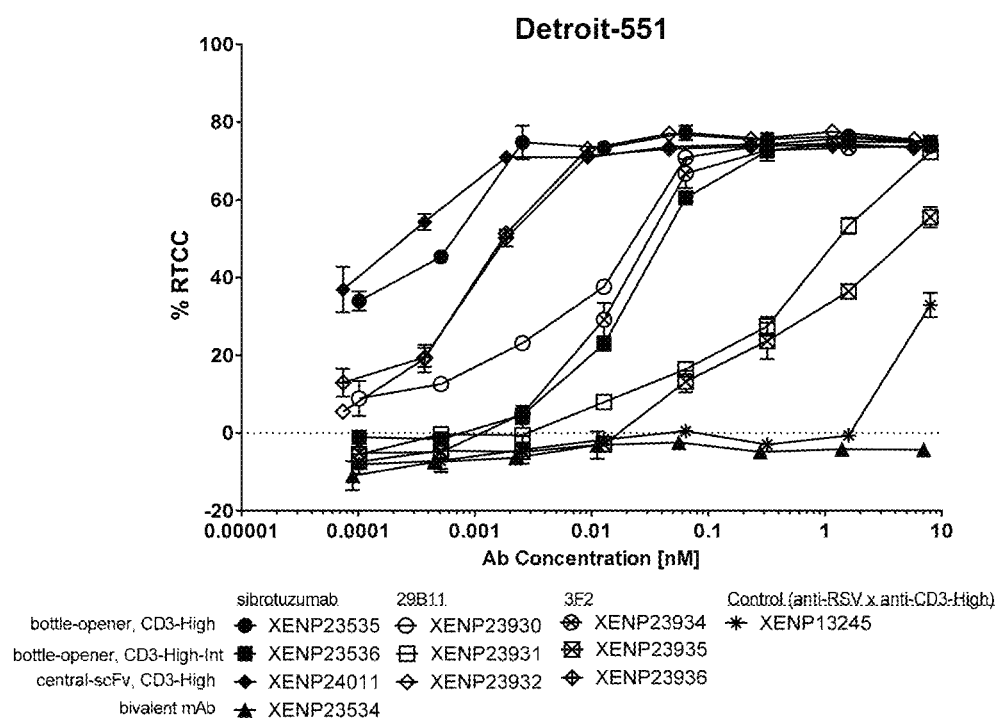
Figure 31B:
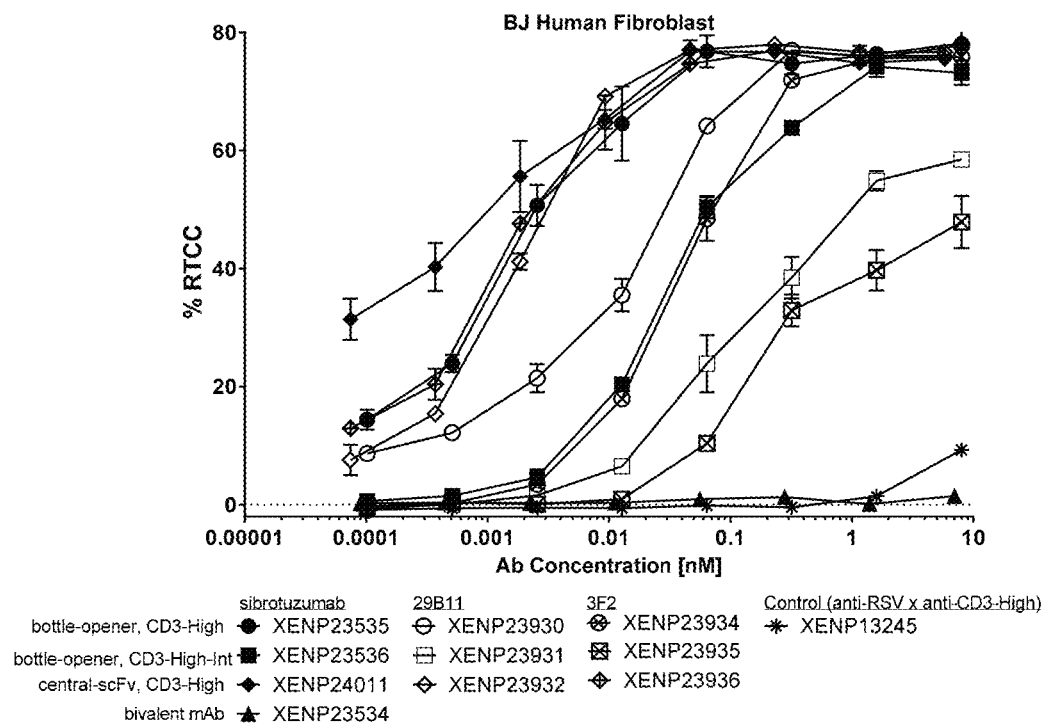
Figure 31C:
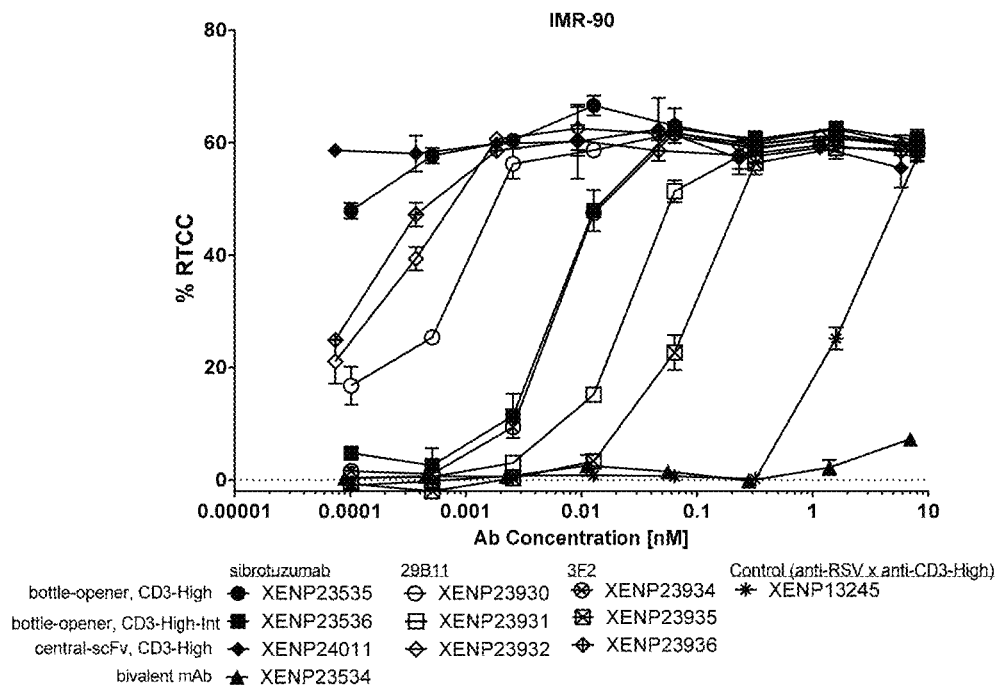
Figure 31D:
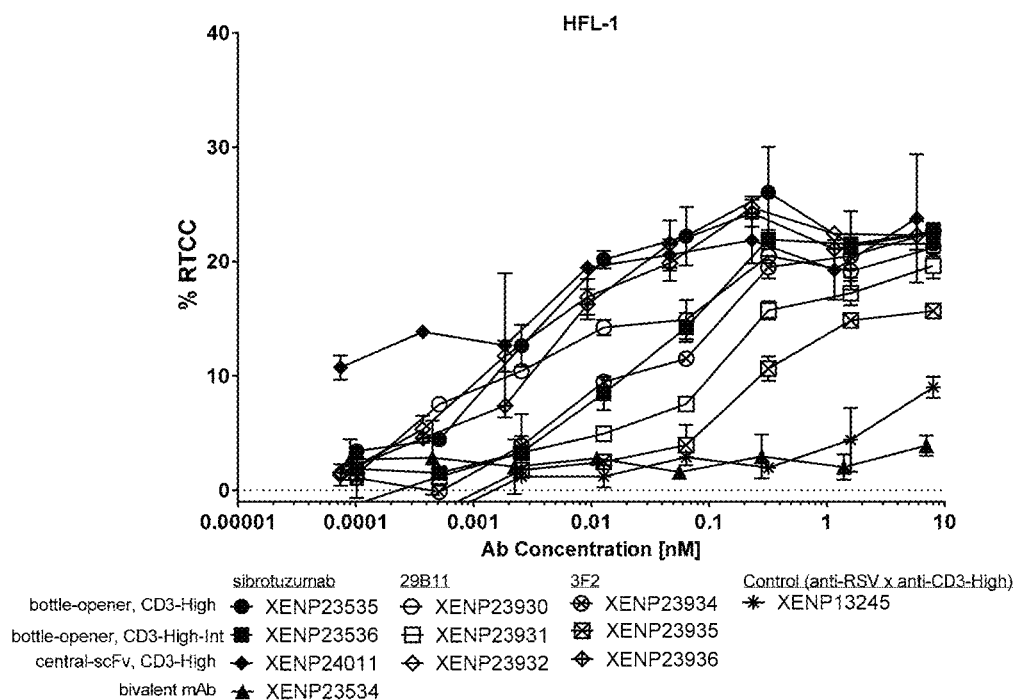

FIG. 26 depicts binding of illustrative anti-FAP mAbs XENP23534 (circle), XENP24460 (square), and XENP24861 (triangle) to mesenchymal stem cells (MSC), hematopoietic stem cells (HSC), CD31$^+$FAP$^+$ cells, WI-38 cells, and Detroit-551 cells as indicated by MFI.

FIG. 27 depicts $K_D$ of prototype anti-FAP×anti-CD3 bsAbs for human and cynomolgus FAP as determined by Octet. $K_D$ values for central-scFv format bsAbs should be considered as $K_D$(apparent) values due to avidity factor.

FIG. 28A-28D depicts binding of prototype anti-FAP (variable region from sibrotuzumab)×anti-CD3 bsAbs to A) WI-38 cells, B) SW872 cells, C) HFL-1 cells, and D) Detroit-551 cells. Circles indicate bsAbs with CD3-High, squares indicate bsAbs with CD3-High-Int, and triangles indicate bsAbs with CD3-Intermediate.

FIG. 29 depicts the EC50 (nM) for cell binding by prototype anti-FAP (variable region from sibrotuzumab)×anti-CD3 bsAbs.

FIGS. 30A-30D depict RTCC on A) WI-38, B) SW872, C) HFL-1, and D) Detroit-551 cells by additional prototype anti-FAP (variable region from sibrotuzumab)×anti-CD3 bsAbs in various formats. Circles indicate bsAbs with CD3-High, squares indicate bsAbs with CD3-High-Int, and triangles indicate bsAbs with CD3-Intermediate.

FIGS. 31A-31D depict RTCC on A) Detroit-551, B) BJ human fibroblast, C) IMR-90, and D) HFL-1 cells by prototype anti-FAP×anti-CD3 bsAbs in various formats. Circles indicate bottle-opener bsAbs with CD3-High. Squares indicate bottle-opener bsAbs with CD3-High-Int. Diamonds indicate central-scFv bsAbs with CD3-High. Triangles indicate bivalent mAbs.

Figure 32A:
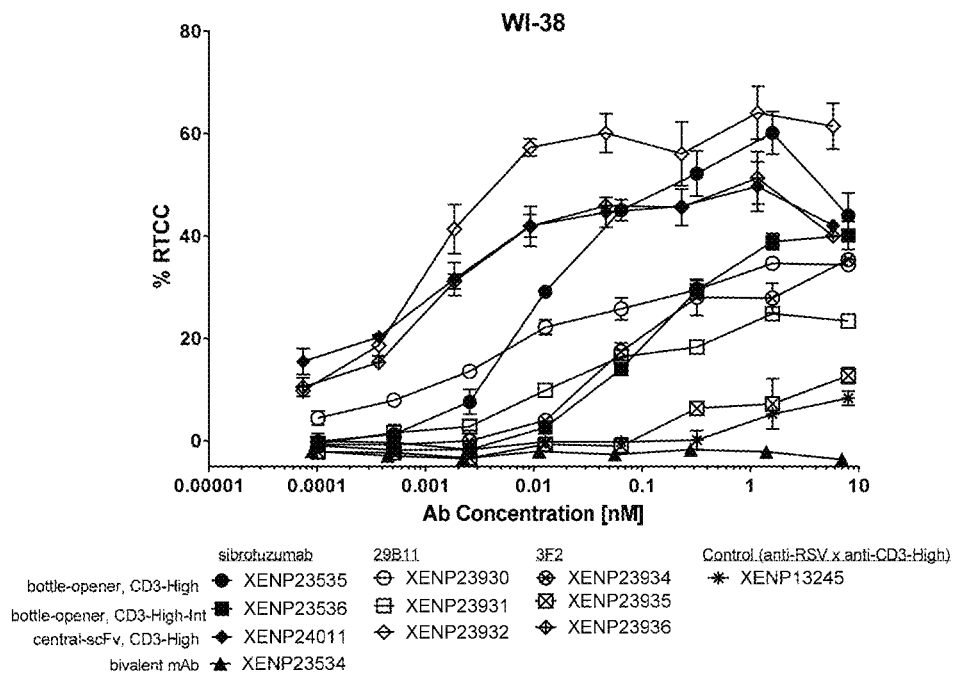
Figure 32B:
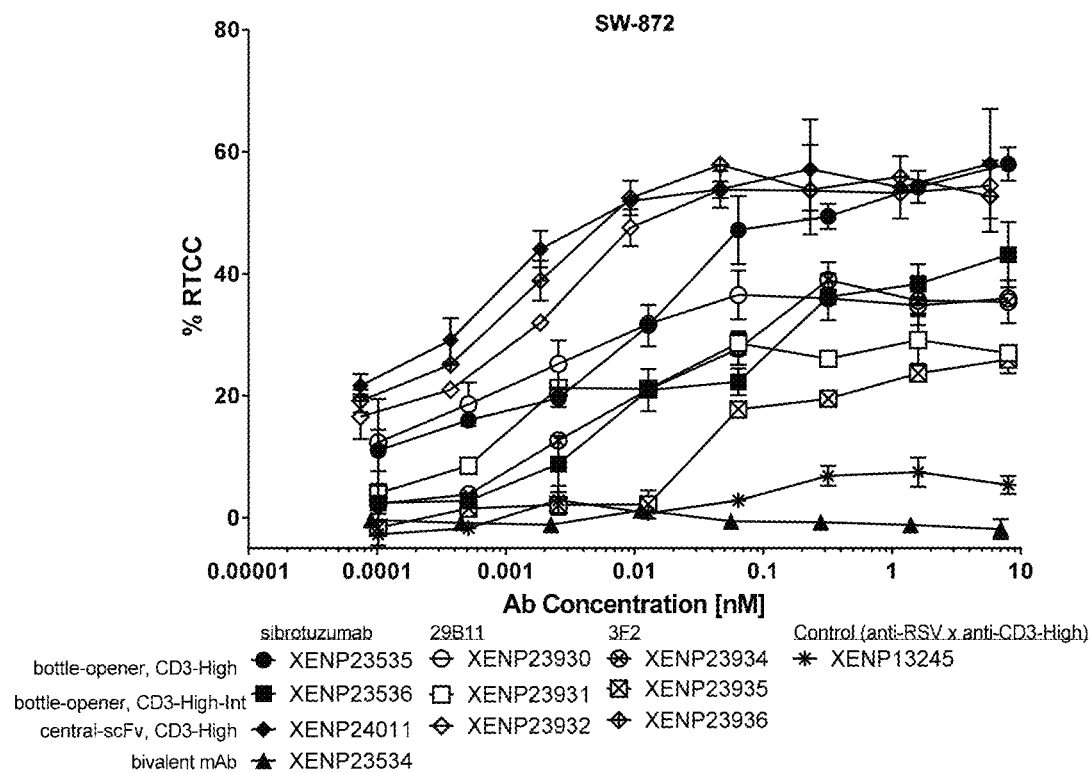

FIG. 32A-32B depicts RTCC on A) WI-38 or B) SW872 cells by prototype anti-FAP×anti-CD3 bsAbs in various formats. Circles indicate bottle-opener bsAbs with CD3-High. Squares indicate 1+1 Fab-scFv-Fc bsAbs with CD3-High-Int. Diamonds indicate 2+1 Fab2-scFv-Fc bsAbs with CD3-High. Triangles indicate bivalent mAbs.

FIG. 33 depicts the $K_D$ of phage-derived anti-FAP antibodies and XENP23534 (as a control) for human, cyno, and murine FAP.

Figure 34:
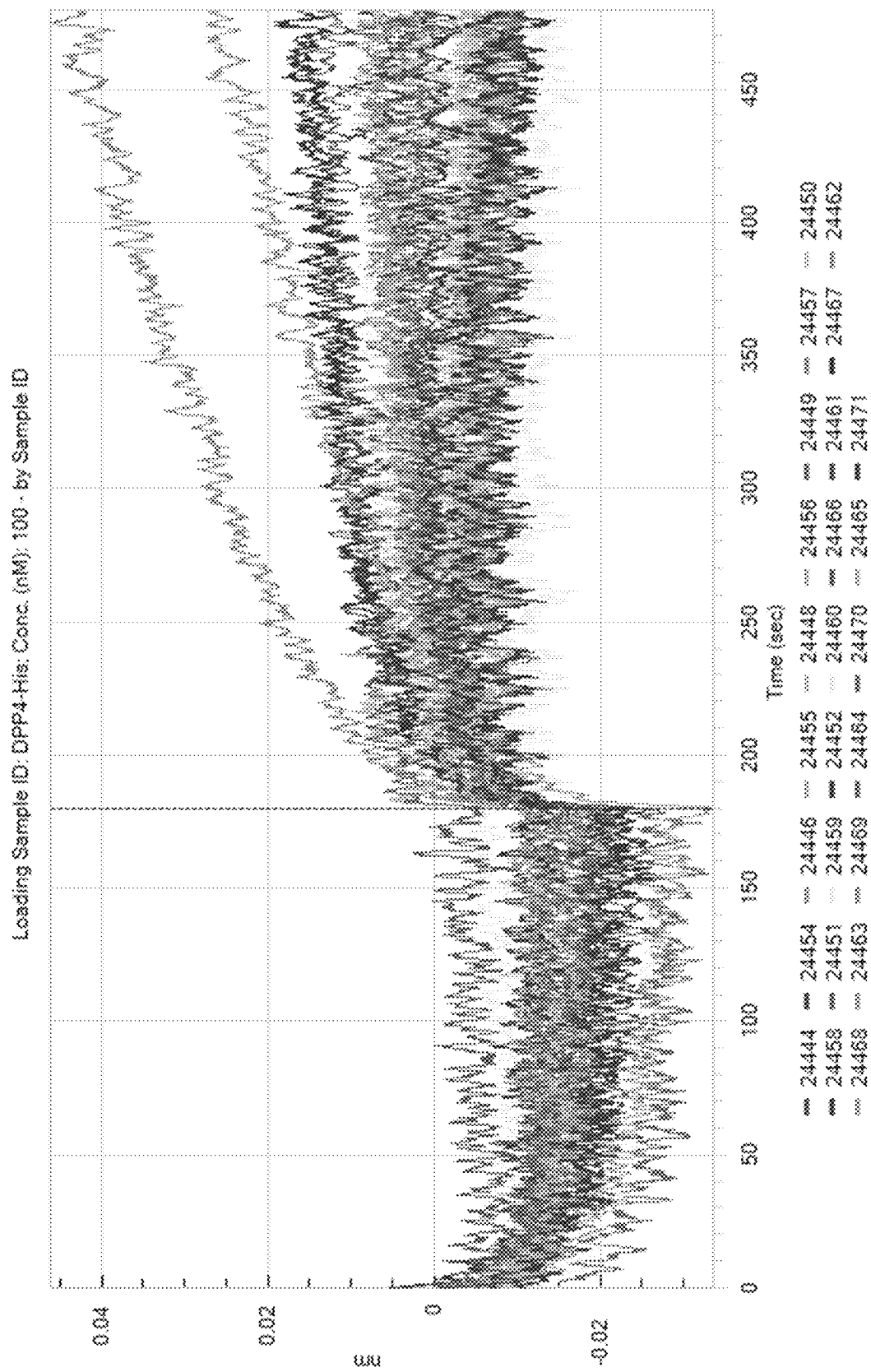

FIG. 34 depicts sensorgrams showing lack of binding of phage-derived anti-FAP antibodies to DPP4.

FIG. 35 depicts epitope binning of phage-derived anti-FAP antibodies as indicated by normalized BLI-response Octet. Normalized BLI-response less than 0.41 indicates that the two antibodies does not bin to the same epitope.

Figure 36:
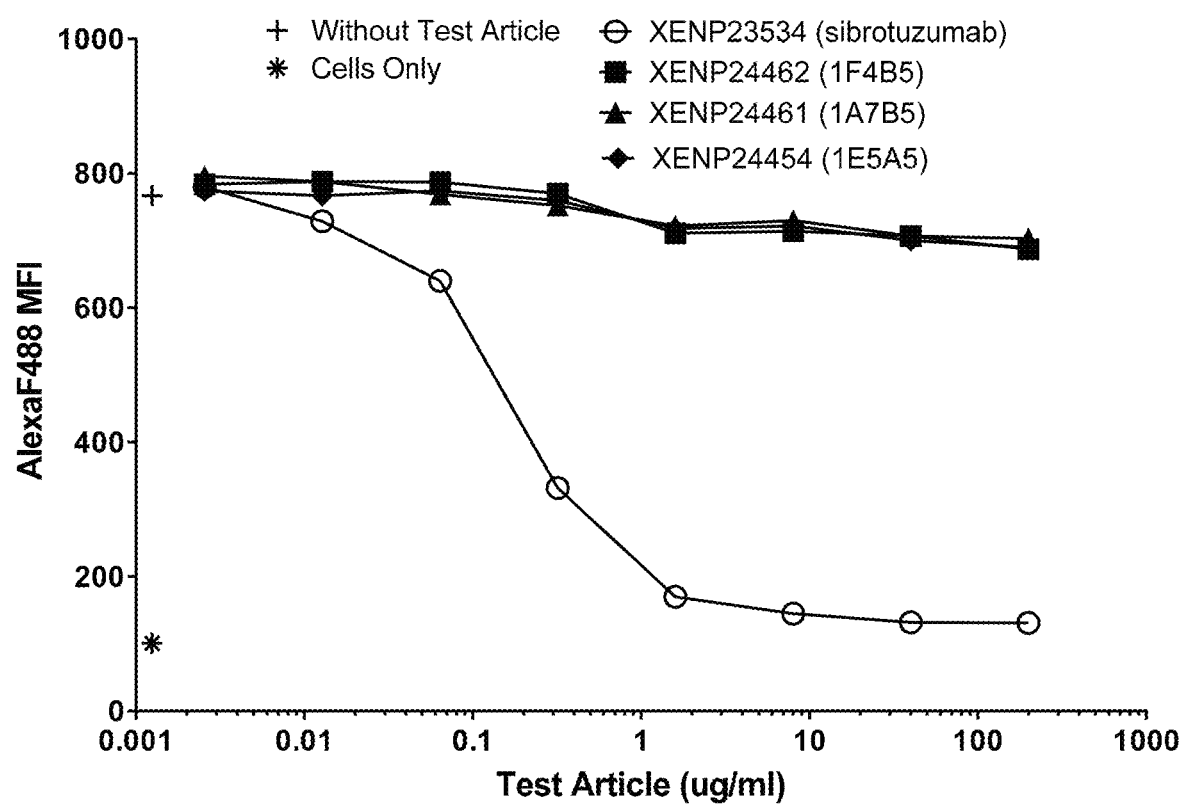
Figure 37A:
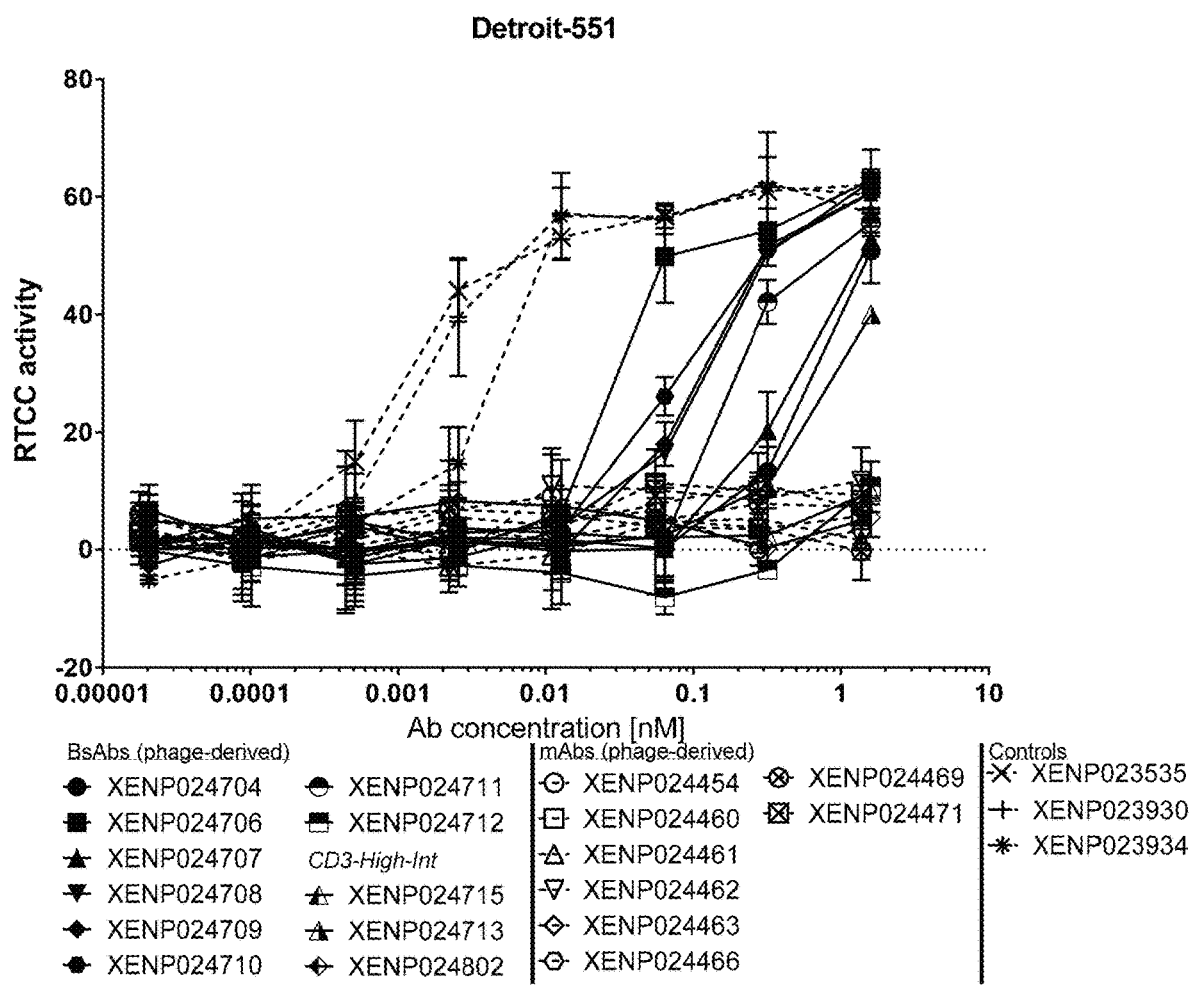
Figure 37B:
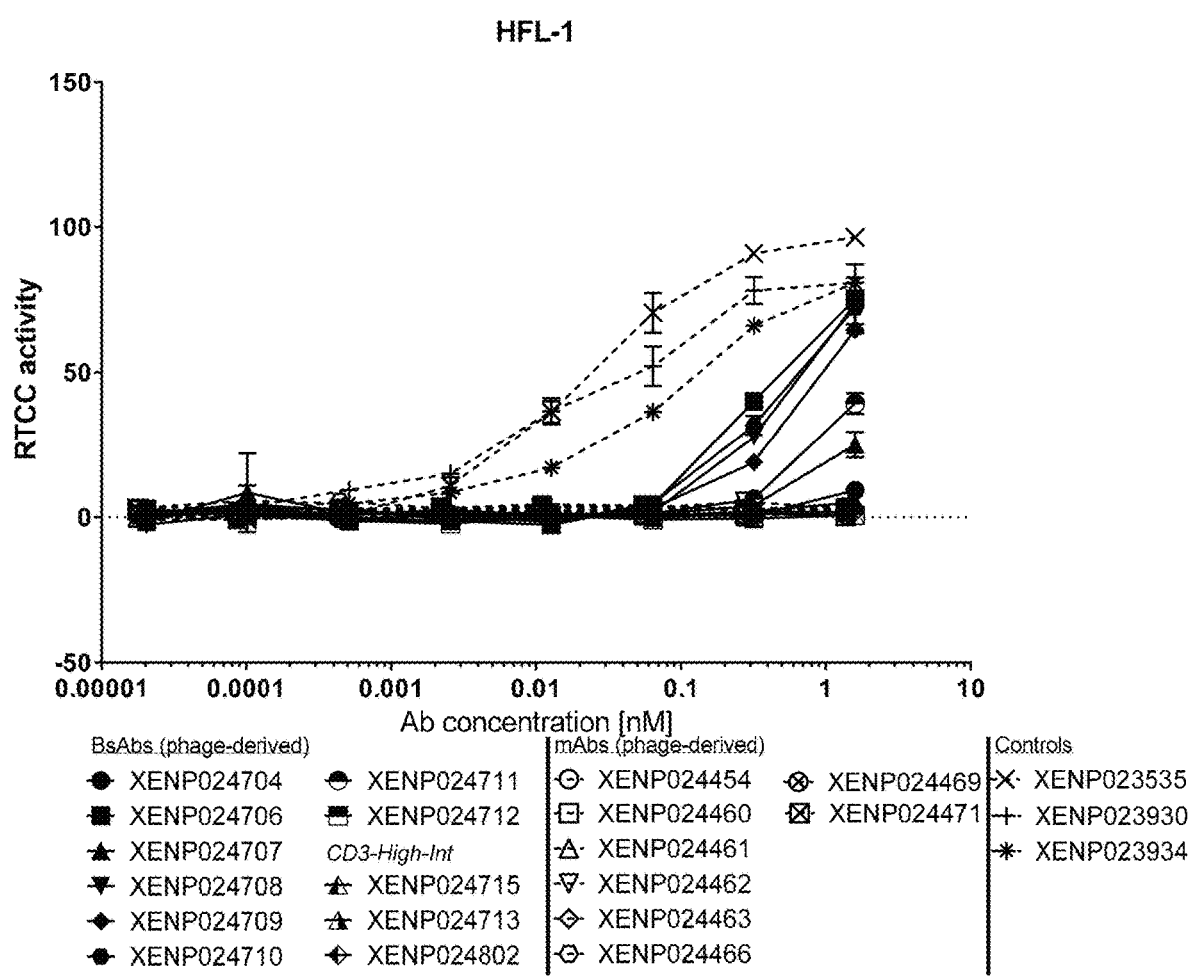
Figure 37C:
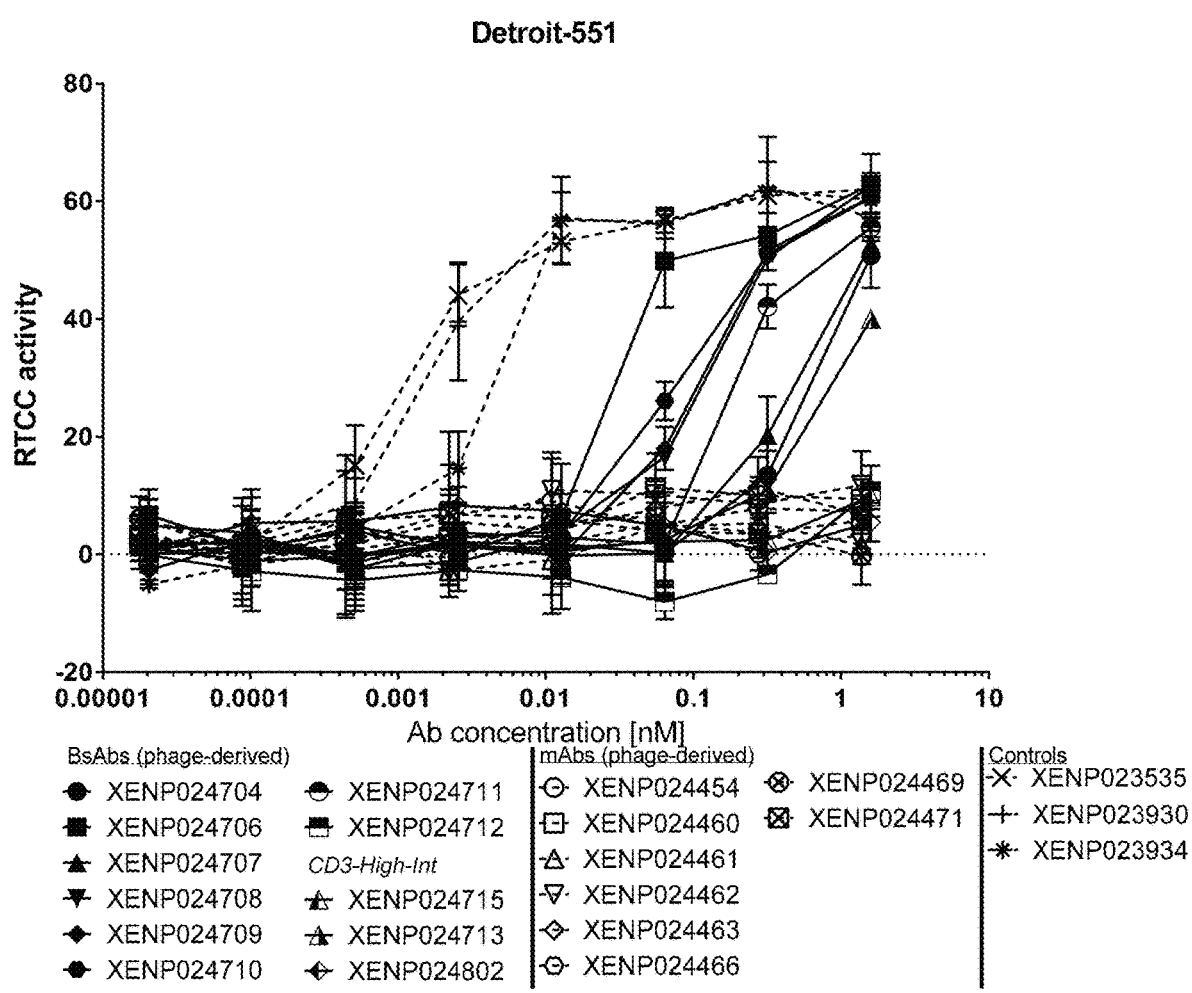
Figure 37D:
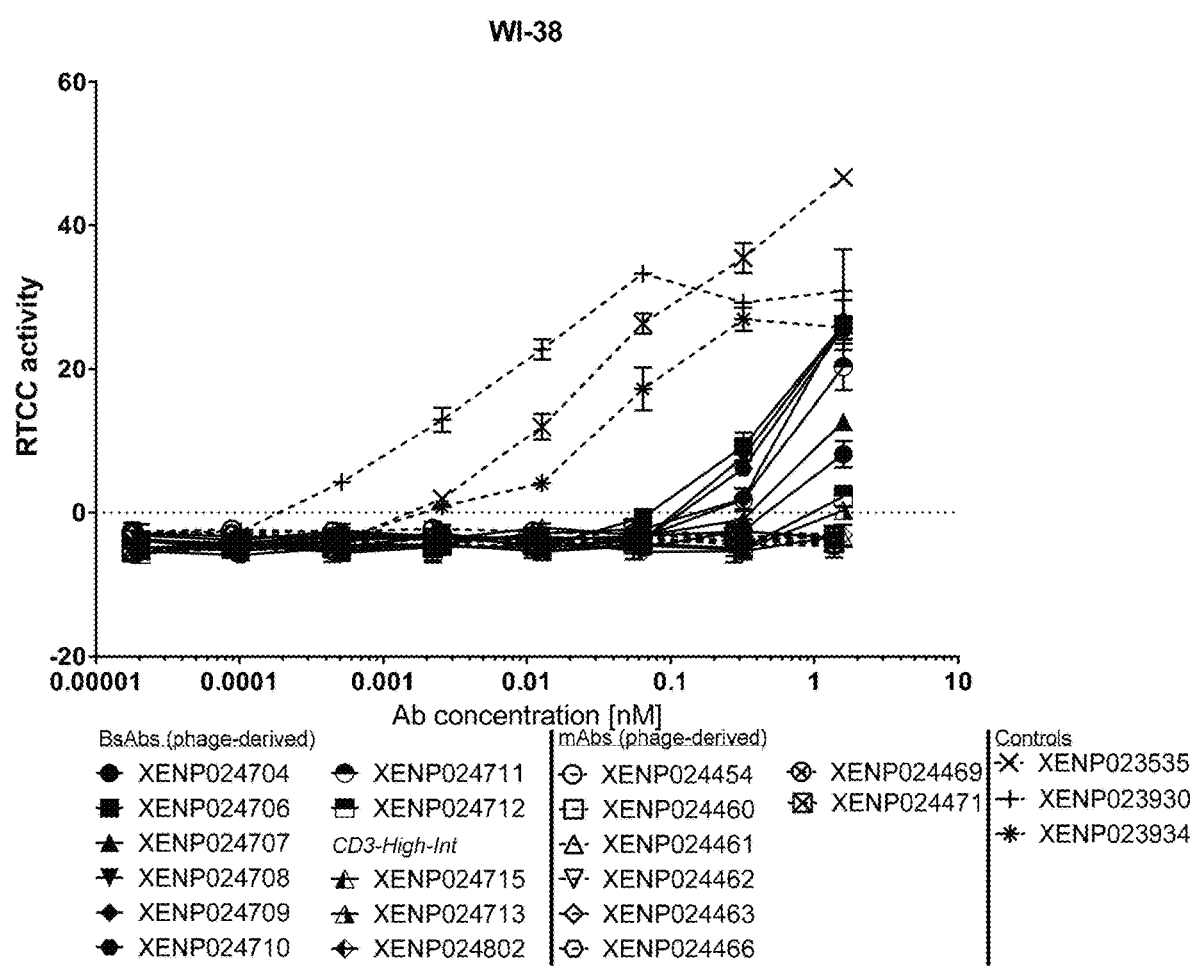

FIG. 36 depicts binding to WI-38 cells by sibrotuzumab (XENP23434) following incubation with exemplary phage-derived anti-FAP antibodies.

FIG. 37A-37D depicts RTCC on A) Detroit-551, B) SW872, and C) WI-38 cells phage-derived anti-FAP domains in either 1+1 Fab-scFv-Fc bsAb format or bivalent mAb (ablated effector function) format.

Figure 38A:
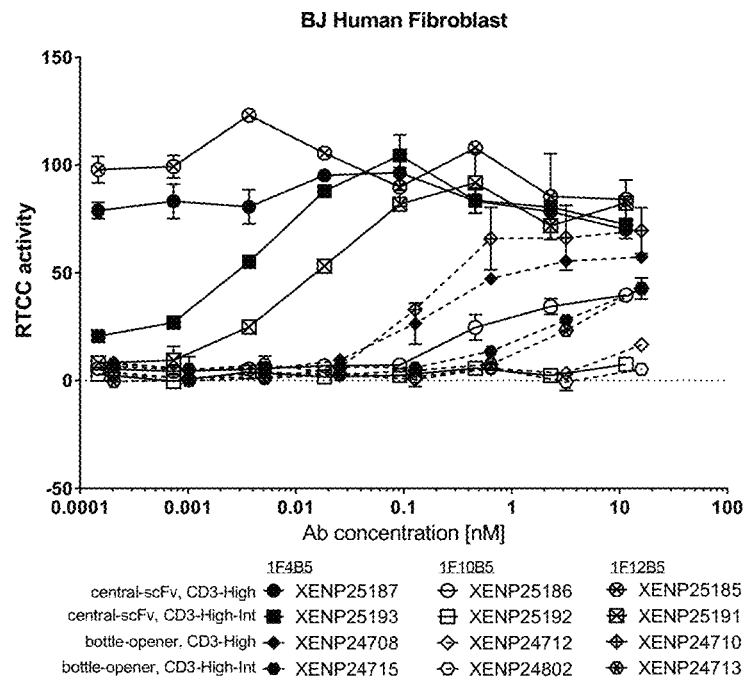
Figure 38B:
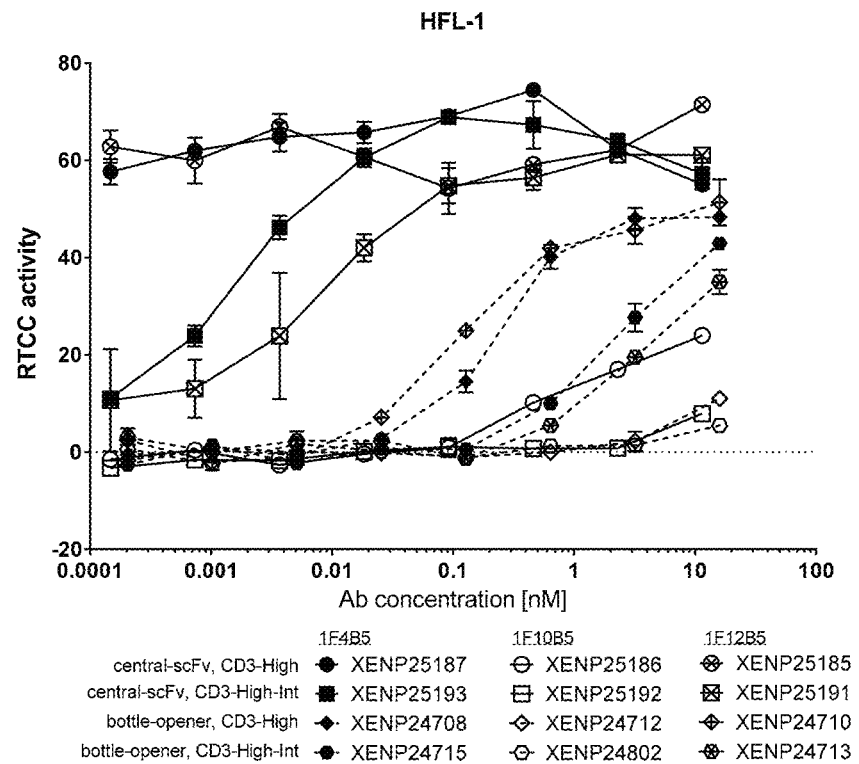
Figure 38C:
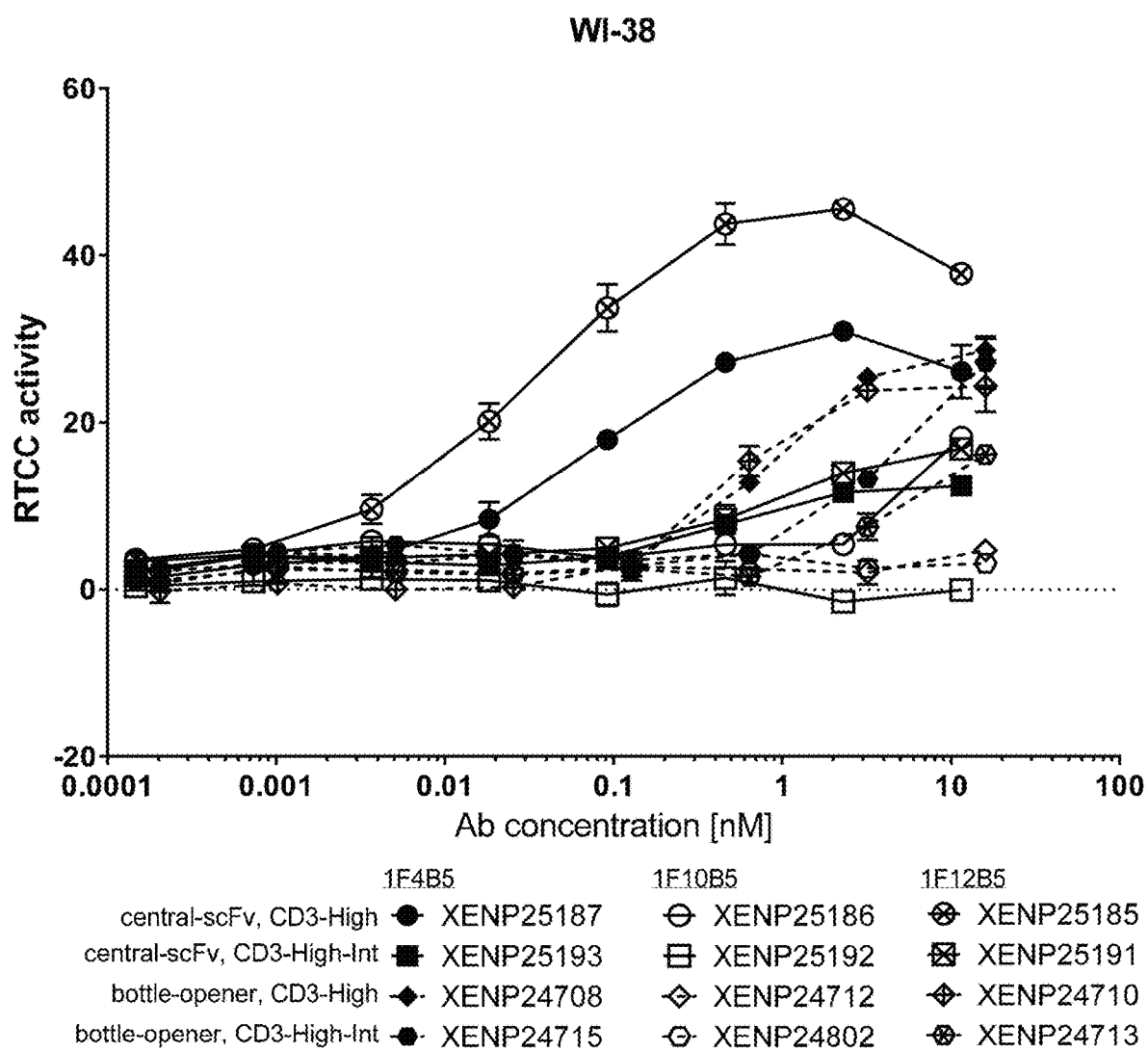

FIG. 38A-38C depicts RTCC on A) BJ human fibroblasts, B) HFL-1, and C) WI-38 cells by anti-FAP×anti-CD3 bsAbs in various formats with anti-FAP arms derived from phage clones 1F4B5, 1F10B5, 1F12B5. Circles indicate 2+1 Fab2-scFv-Fc format with CD3-High, squares indicate 2+1 Fab2-scFv-Fc format with CD3-High-Int, diamonds indicate bottle-opener format with CD3-High, and hexagons indicate 1+1 Fab-scFv-Fc format with CD3-High-Int.

Figure 39A:
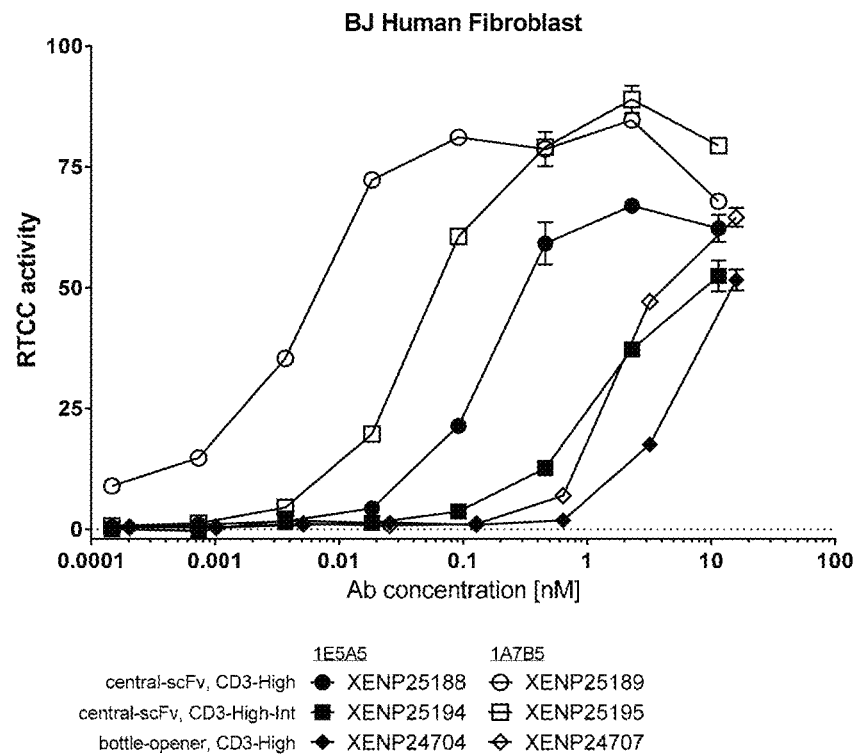
Figure 39B:
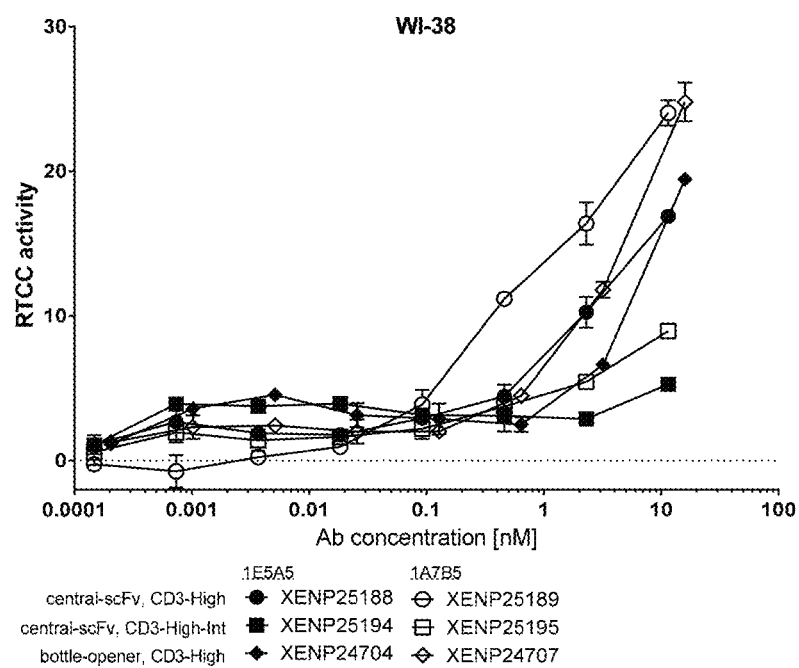

FIGS. 39A-39B depict RTCC on A) BJ human fibroblasts and B) WI-38 cells by anti-FAP×anti-CD3 bsAbs in various formats with anti-FAP arms derived from phage clones 1A7B5 and 1E5A5. Circles indicate 2+1 Fab2-scFv-Fc format with CD3-High, squares indicate 2+1 Fab2-scFv-Fc format with CD3-High-Int, and diamonds indicate 1+1 Fab-scFv-Fc format with CD3-High.

Figure 40A:
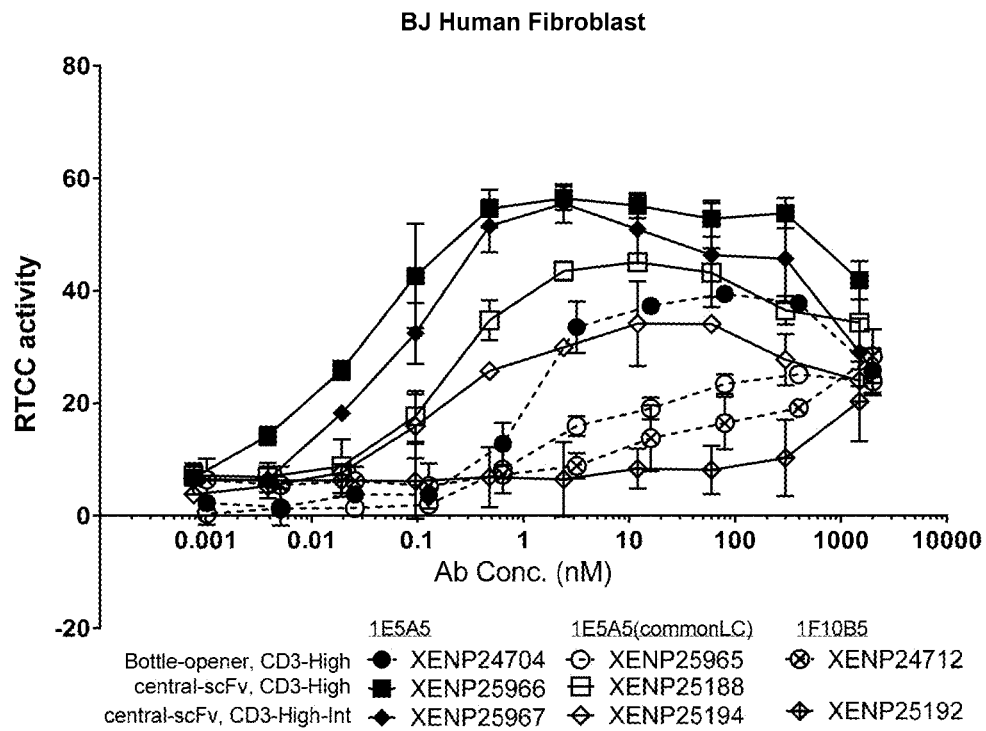
Figure 40B:
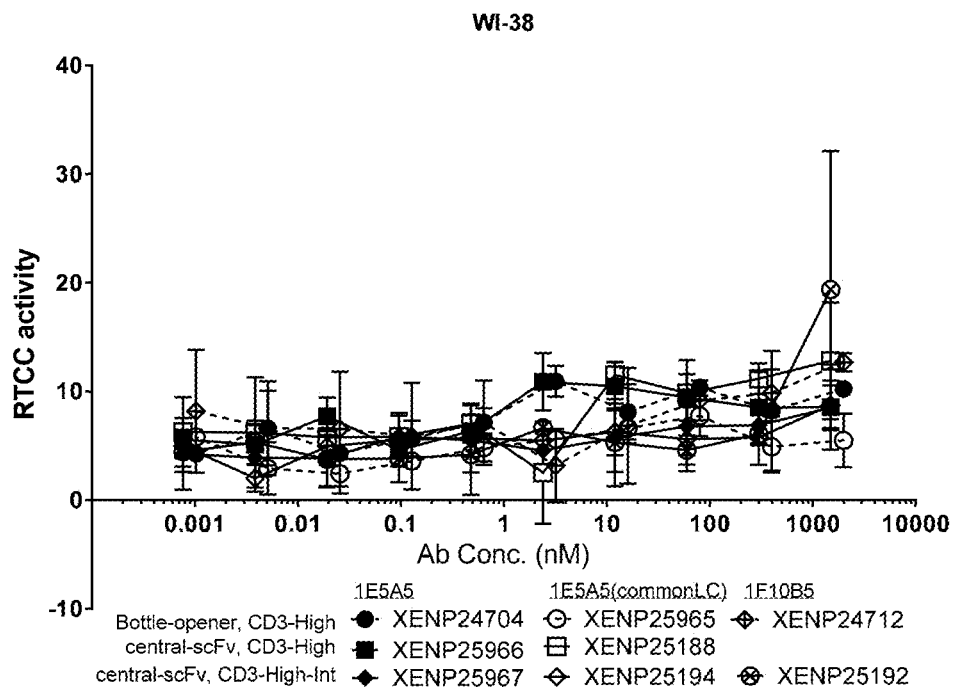

FIGS. 40A-40B depicts RTCC on A) BJ human fibroblasts and B) WI-38 cells by anti-FAP×anti-CD3 bsAbs in various formats with anti-FAP arms derived from phage clones 1E5A5, 1F10B5, and 1F11B5 as well as 1E5A5 with the light chain variable region with human germline VLk 1-39 sequence. Circles indicate 1+1 Fab-scFv-Fc format bsAbs with CD3-High, squares indicate central-scFv bsAbs with CD3-High, and diamonds indicate 2+1 Fab2-scFv-Fc format bsAbs with CD3-High-Int.

Figure 41A:
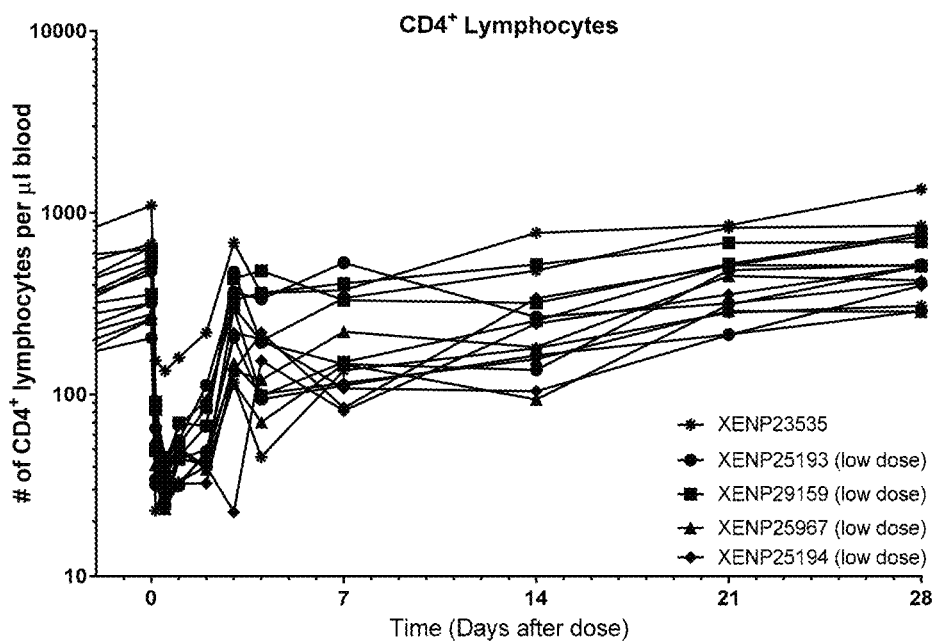
Figure 41B:
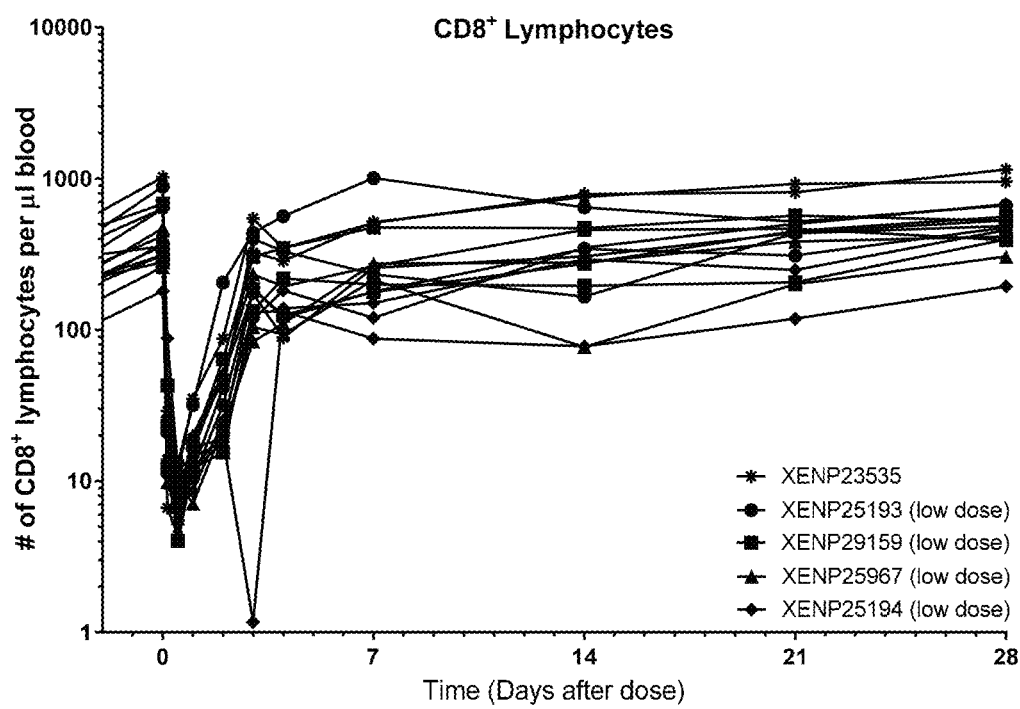

FIGS. 41A-41B depicts A) CD4⁺ and B) CD8⁺ lymphocyte counts in peripheral blood of cynomolgus monkeys before and after dosing with low dose administration of exemplary anti-FAP×anti-CD3 bsAbs and control XENP23535.

Figure 42A:
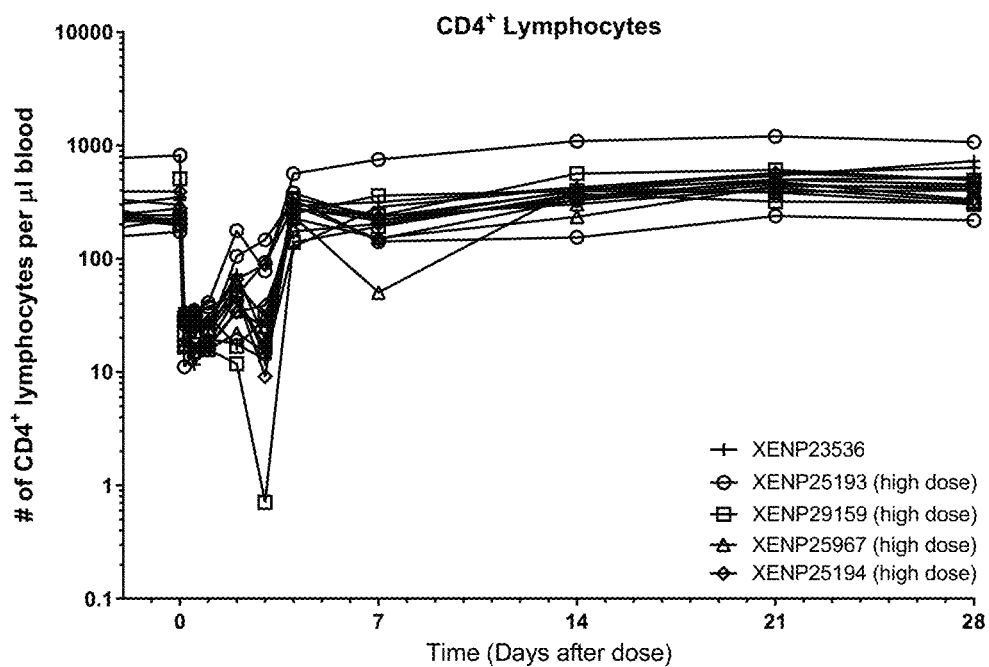
Figure 42B:
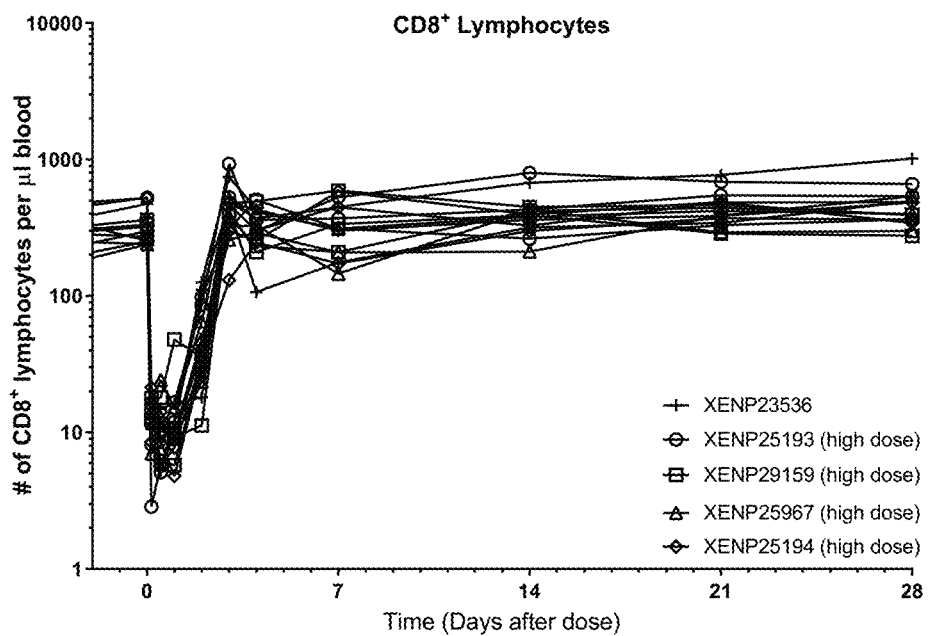

FIGS. 42A-42B depicts A) CD4⁺ and B) CD8⁺ lymphocyte counts in peripheral blood of cynomolgus monkeys before and after dosing with high dose administration of exemplary anti-FAP×anti-CD3 bsAbs and control XENP23536.

FIGS. 43A and 43B depict matrices of possible combinations for exemplary bispecific anti-FAP×anti-CD3 antibodies described herein. An "A" means that the CDRs of the referenced CD3 binding domain sequences at the top of the matrix can be combined with the CDRs of the FAP binding domain sequences listed on the left hand side of the matrix. For example, with respect to "Anti-FAP 1A4A5 H1_L1" and "Anti-CD3 H1.30_L1.47", "A" indicates a bispecific antibody that includes a) a CD3 binding domain having vhCDRs from the H1.30_L1.47 CD3 binding domain variable heavy chain (H1.30) sequence and the vlCDRs from the CD3 H1.30_L1.47 variable light chain (L1.47) sequence, and b) a FAP binding domain having the vhCDRs from the 1A4A5 FAP binding domain H1 sequence and the vlCDRs from the 1A4A5 FAP binding domain L1 sequence. A "B" means that the CDRs from the CD3 binding domain constructs can be combined with the variable heavy and light domains from the FAP binding domain constructs. For example, with respect to "Anti-FAP 1A4A5" and "Anti-CD3 H1.30_L1.47", "B" indicates a bispecific antibody that includes a) a CD3 binding domain having the vhCDRs from the CD3 H1.30_L1.47 binding domain variable heavy chain (H1.30) sequence and the vlCDRs from the CD3 H1.30_L1.47 binding domain variable light chain (L1.47) sequence, and b) a FAP binding domain having the variable heavy domain having the FAP 1A4A5 H1 sequence and the variable light domain of having the FAP 1A4A5_L1 sequence. A "C" indicates a bispecific antibody that includes a) a CD3 binding domain having a variable heavy domain and variable light domain from the indicated CD3 binding domain, and b) a FAP binding domain with the vhCDR1-3 and vlCDR1-3 of the indicated FAP binding domain. A "D" indicates a bispecific antibody that includes a FAP binding domain having the variable heavy and variable light chain of the indicated FAP binding domain and a CD3 binding domain having the variable heavy and variable light chain of the indicated anti-CD3 sequence. An "E" indicates a bispecific antibody that includes an scFv, where the scFv of the CD3 is used with the vhCDR1-3 and vlCDR1-3 of the indicated FAP binding domain. An "F" indicates a bispecific antibody that includes an scFv, where the scFv of the CD3 is used with the variable heavy and variable light domains of the indicated FAP binding domain.

All of these combinations can be done in 1+1 Fab-scFv-Fc formats (e.g., using any of the 1+1 Fab-scFv-Fc backbone formats shown in FIG. 9) and the central-scFv formats (e.g., using any of the central-scFv backbones shown in FIG. 10). These combinations can also be utilized in alternative formats, such as mAb-Fv, mAb-scFv, central-Fv or dual scFv formats of FIG. 1, including the format backbones shown in FIG. 11. For example, "A"s (CD3 binding domain CDRs and FAP binding domain CDRs) can be added to 1+1 Fab-scFv-Fc sequences (e.g., those of FIG. 9 or inclusive of different heterodimerization variants), to central-scFv (e.g., those of FIG. 10), or into a mAb-scFv backbone of FIG. 11. In general, however, formats that would include bivalent binding of CD3 are disfavored. Thus in some embodiments utilizing trivalent formats, such as central-scFv, the anti-CD3×anti-FAP bispecific antibody would include two FAP binding domains and one CD3 binding domain. In some embodiments of such trivalent antibody formats that include an scFv, the scFv is the CD3 binding domain (see, e.g., FIG. 16B).

FIGS. 43C and 43D depict matrices of possible combinations for exemplary bispecific anti-FAP×anti-CD3 1+1 Fab-scFv-Fc format combinations described herein. In these matrices, the anti-CD3 scFvs are listed in the X axis and the anti-FAP Fabs are listed on the Y axis. An "A" means that the CDRs of the referenced CD3 binding domain sequences at the top of the matrix can be combined with the CDRs of the FAP binding domain sequences listed on the left hand side of the matrix. For example, with respect to "Anti-FAP 1A4A5 H1_L1" and "Anti-CD3 H1.30_L1.47", "A" indicates a bispecific 1+1 Fab-scFv-Fc format antibody that includes a) an anti-CD3 scFV having vhCDRs from the H1.30_L1.47 CD3 binding domain variable heavy chain (H1.30) sequence and the vlCDRs from the H1.30_L1.47 CD3 binding domain variable light chain (L1.47) sequence, and b) an anti-FAP Fab having the vhCDRs from the 1A4A5 FAP binding domain variable heavy chain (H1) sequence and the vlCDRs from the 1A4A5 FAP binding domain variable light chain (L1) sequence. A "B" means that the CDRs from the indicated CD3 binding domain constructs can be combined with the variable heavy and light domains from the indicated FAP binding domain constructs. For example, with respect to "Anti-FAP 1A4A5 H1_L1" and "Anti-CD3 H1.30_L1.47", "B" indicates a bispecific 1+1 Fab-scFv-Fc antibody that includes a) an anti-CD3 scFv having the vhCDRs from the H1.30_L1.47 CD3 binding domain variable heavy chain (H1.30) sequence and the vlCDRs from the H1.30_L1.47 CD3 binding domain variable light chain (L1.47) sequence, and b) an anti-FAP Fab having the 1A4A5 FAP binding domain variable heavy domain (H1) sequence and the 1A4A5 FAP binding domain variable light domain (L1) sequence. A "C" indicates a bispecific 1+1 Fab-scFv-Fc antibody that includes a) anti-CD3 scFv having a variable heavy domain and variable light domain from the anti-CD3 sequences, and b) an anti-FAP Fab with the CDRs of the anti-FAP sequences. A "D" indicates a bispecific 1+1 Fab-scFv-Fc antibody that includes an anti-FAP Fab having the variable heavy and variable light chain of the indicated FAP binding domain and an anti-CD3 scFv having the variable heavy and variable light chain of the indicated CD3 binding domain. An "E" indicates a bispecific 1+1 Fab-scFv-Fc antibody that includes an scFv, where the scFv of the CD3 binding domain is used with the CDRs of the FAP binding domain. An "F" indicates a bispecific antibody that includes an scFv, where the scFv of the CD3 binding domain is used with the variable heavy and variable light domains of the FAP binding domain.

FIGS. 43E and 43F depict matrices of possible combinations for exemplary bispecific anti-FAP×anti-CD3 2+1 Fab2-scFv-Fc format (also referenced to as "central-scFv format") combinations described herein. In these matrices, the anti-CD3 scFvs are listed in the X axis and the two anti-FAP Fabs are listed on the Y axis. An "A" means that the CDRs of the referenced CD3 binding domain sequences at the top of the matrix can be combined with the CDRs of the FAP binding domain sequences listed on the left hand side of the matrix. For example, with respect to "Anti-FAP 1A4A5 H1_L1" and "Anti-CD3 H1.30_L1.47", "A" indicates a bispecific central-scFv format antibody that includes a) an anti-CD3 scFV having vhCDRs from the H1.30_L1.47 CD3 binding domain variable heavy chain (H1.30) sequence and the vlCDRs from the CD3 H1.30_L1.47 binding domain variable light chain (L1.47) sequence, and b) anti-FAP Fab domains having the vhCDRs from the FAP binding domain 1A4A5 heavy chain (H1) sequence and the vlCDRs from the FAP binding domain 1A4A5 light chain (L1) sequence. A "B" means that the CDRs from the indicated CD3 binding domain constructs can be combined with the variable heavy and light domains from the indicated FAP binding domain constructs. For example, with respect to "Anti-FAP 1A4A5 H1_L1" and "Anti-CD3 H1.30_L1.47", "B" indicates a bispecific central-scFv antibody that includes a) an anti-CD3 scFv having the vhCDRs from the H1.30_L1.47 CD3 binding domain variable heavy chain (H1.30) sequence and the vlCDRs from the H1.30_L1.47 CD3 binding domain variable light chain (L1.47) sequence, and b) anti-FAP Fab domains having the 1A4A5 FAP binding domain variable heavy domain (H1) sequence and the 1A4A5 FAP binding domain variable light domain (L1) sequence. A "C" indicates a central-scFv antibody that includes a) anti-CD3 scFv having a variable heavy domain and variable light domain from the indicated CD3 binding domain sequence, and b) FAP Fab domains with the CDRs of the indicated FAP binding domain sequences. A "D" indicates a central-scFv antibody that includes anti-FAP Fab domains having the variable heavy and variable light chain of the indicated FAP binding domain sequence and an anti-CD3 scFv having the variable heavy and variable light chain of the indicated CD3 binding domain sequence. An "E" indicates a central-scFv antibody that includes an scFv, where an scFV of the indicated CD3 binding domain is used with the CDRs of the FAP antigen binding domain. An "F" indicates a central-scFv antibody that includes an scFv, where the scFv of the indicated CD3 binding domain is used with the variable heavy and variable light domains of the indicated FAP antigen binding domain.

Figure 44A:
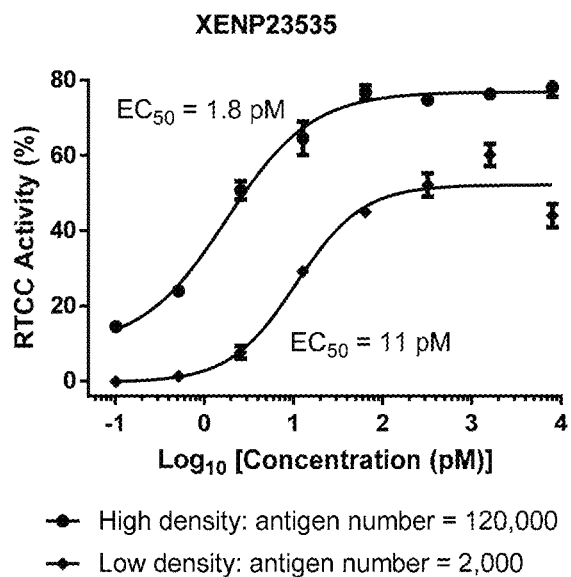
Figure 44B:
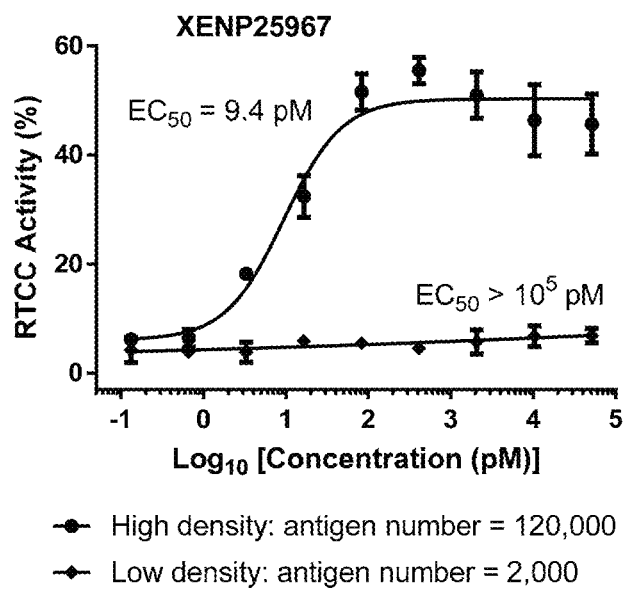

FIGS. 44A and 44B depicts RTCC activity of A) XENP23535, an anti-FAP×anti-CD3 bsAb in the 1+1 Fab-scFv-Fc format, and B) XENP25967, an anti-FAP×anti-CD3 bsAb in the 2+1 Fab2-scFv-Fc format on FAP$^{high}$ cells (BJ human fibroblasts) and FAP$^{low}$ cells (WI-38), and show that XENP25967 is highly selective for cells with high tumor antigen density in comparison to XENP23535 which was more broadly reactive.

FIGS. 45A-45W depicts sequences for XENP23533, a Fab fragment based on a high-affinity FAP binding domain, and illustrative anti-FAP Fab fragments from an affinity de-maturation library for the high-affinity FAP binding domain. The CDRs are underlined, and the slashes (/) indicate the border(s) of the variable domains. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in in a Fab format or in an scFv format. It is important to note that these sequences were generated using polyhistidine (His6 (SEQ ID NO: 1175) or HHHHHH (SEQ ID NO: 1175) tags at the C-terminus of the heavy chains, which have been removed.

FIG. 46 depicts sequences for XENP22476, HIS-Avi-Fc-huFAP antigen used for screening the affinity of anti-FAP Fab variants.

FIG. 47 depicts dissociation constant ($K_D$), association rate ($k_a$), and dissociation rate ($k_d$) of anti-FAP Fab variants from an affinity de-maturation library for FAP.

FIG. 48 depicts dissociation constant ($K_D$), association rate ($k_a$), and dissociation rate ($k_d$) of anti-FAP Fab variants from an affinity de-maturation library for FAP.

FIGS. 49A-49B depicts dissociation constant ($K_D$), association rate ($k_a$), and dissociation rate ($k_d$) of anti-FAP Fab variants from an affinity de-maturation library for FAP.

FIG. 50 depicts dissociation constant ($K_D$), association rate ($k_a$), and dissociation rate ($k_d$) of anti-FAP Fab variants from an affinity de-maturation library for FAP.

FIGS. 51A-51H depicts the amino acid sequences of illustrative anti-FAP×anti-CD3 bispecific antibodies in the 2+1 Fab2-scFv-Fc format comprising affinity de-matured anti-FAP binding domains. The antibodies are named using the Fab variable region first and the Fab-scFv variable regions second, separated by a dash. CDRs are underlined and slashes indicate the border(s) of the variable regions. The scFv domain has orientation (N- to C-terminus) of VH-scFv linker-VL, although this can be reversed. In addition, each sequence outlined herein can include or exclude the M428L/N434S variants in one or preferably both Fc domains, which results in longer half-life in serum.

Figure 52A:
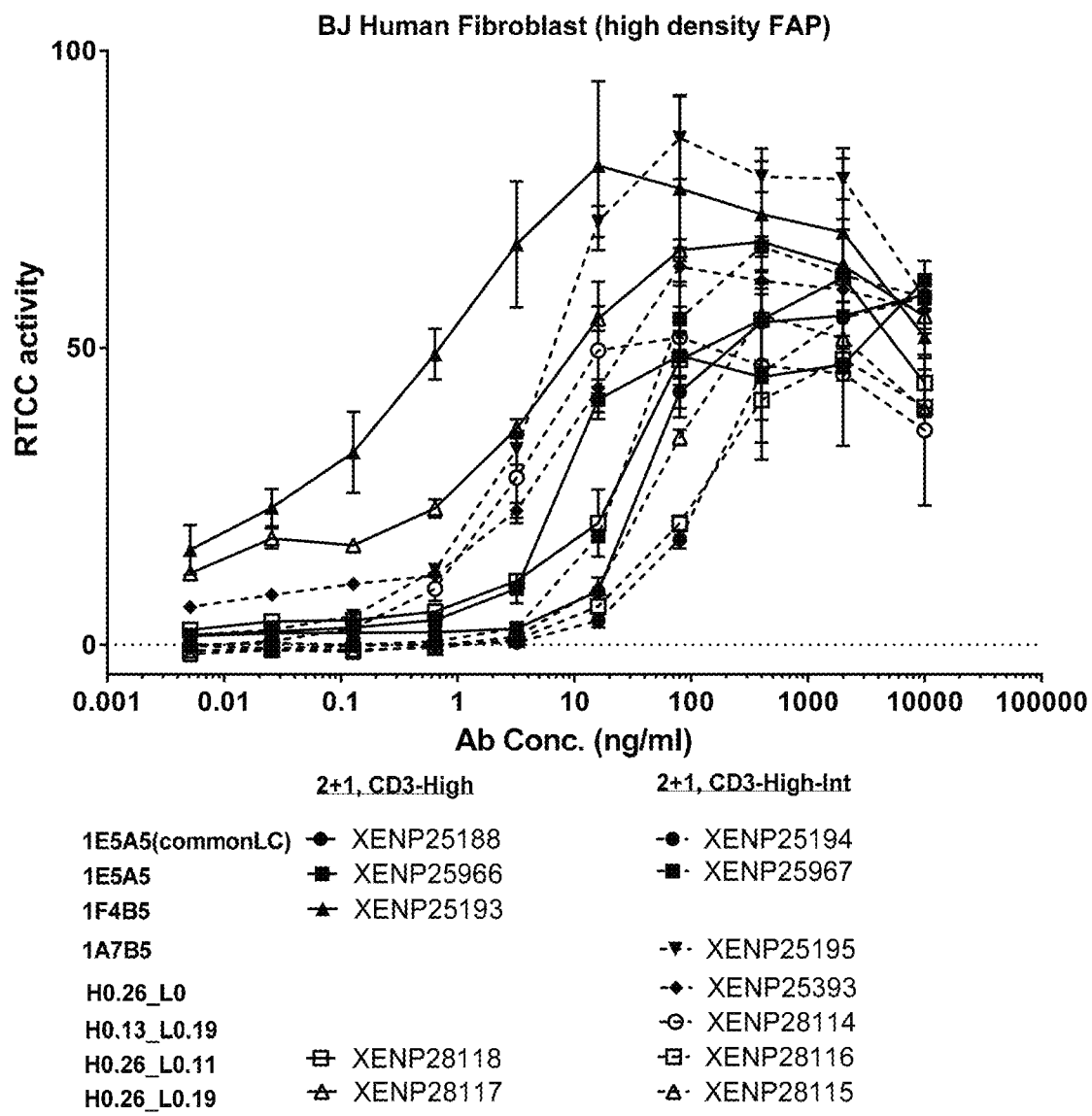

FIGS. 52A and B depict induction of RTCC on A) BJ human fibroblasts and B) SV40-transformed WI-38 (VA13) by anti-FAP×anti-CD3 bsAbs in the 2+1 Fab2-scFv-Fc format with affinity de-matured FAP binding domains or with phage-derived FAP binding domains.

FIG. 53 depicts the percentage of CD4+ T cells expressing A) CD69, B) CD25, and C) CD107a following incubation of BJ human fibroblasts cells for 24 hours with human PBMCs (10:1 effector to target cell ratio) and anti-FAP×anti-CD3 bsAbs in the 2+1 Fab2-scFv-Fc format with affinity de-matured FAP binding domains. The data show that bsAbs having lower affinity FAP-binding arms (for example, XENP28393, XENP28115, and XENP28116) were less potent in activating T cells than bsAbs having higher affinity FAP-binding arms (for example, XENP28114).

Figure 54:
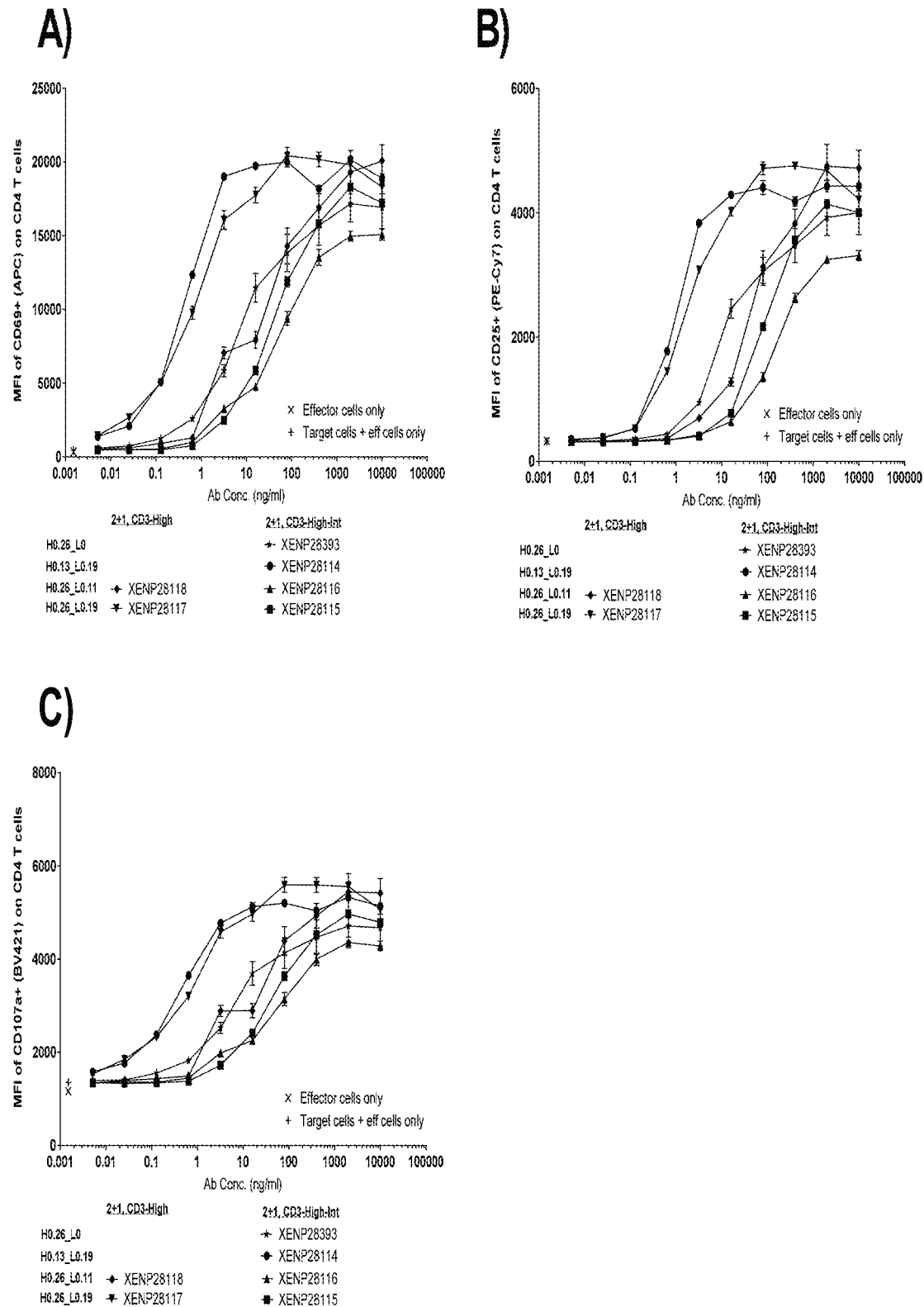

FIG. 54 depict the upregulation of A) CD69, B) CD25, and C) CD107a on CD4+ T cells (as indicated by MFI) following incubation of BJ human fibroblasts cells for 24 hours with human PBMCs (10:1 effector to target cell ratio) and anti-FAP×anti-CD3 bsAbs in the 2+1 Fab2-scFv-Fc format with affinity de-matured FAP binding domains.

Figure 55:
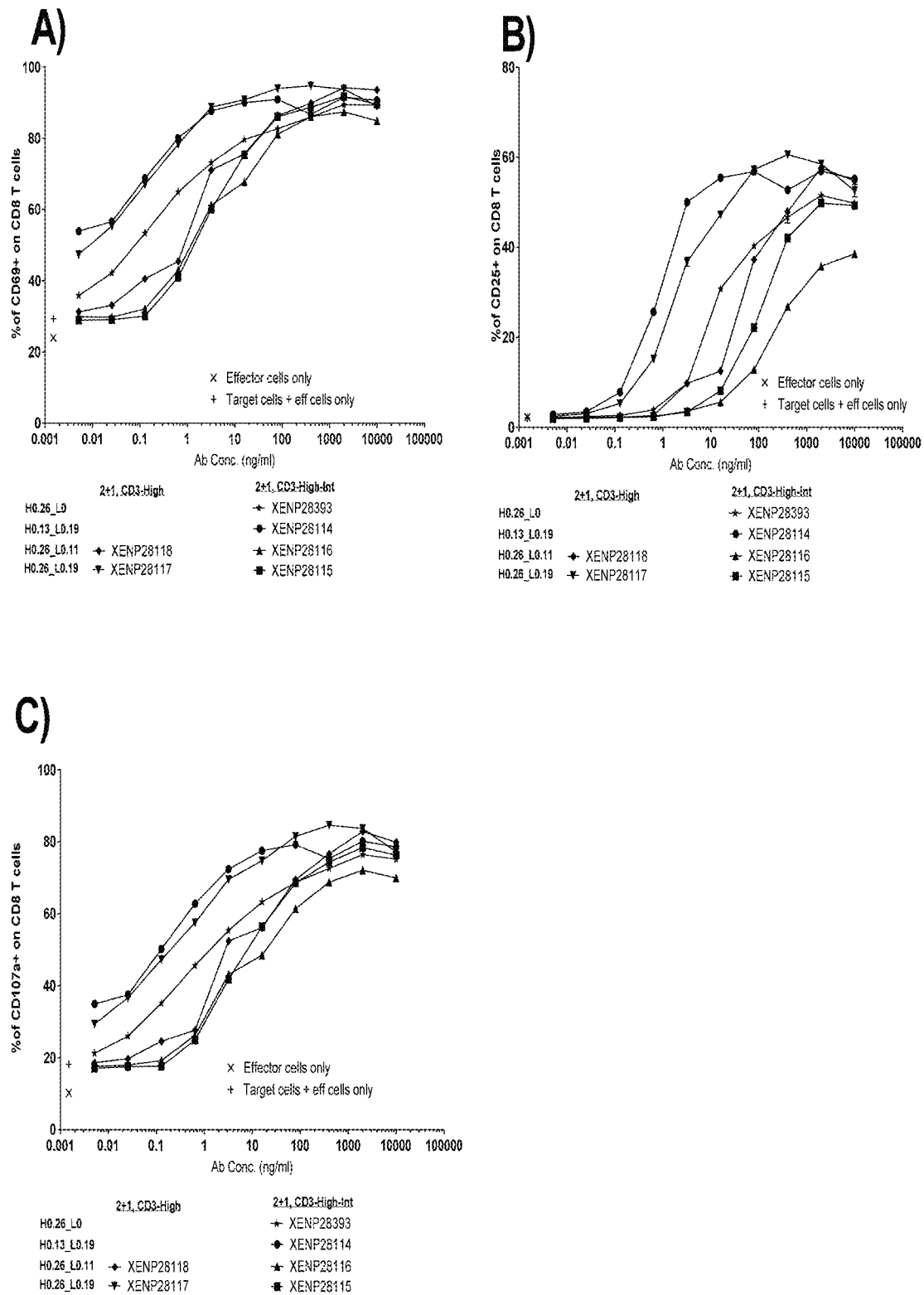

FIG. 55 depict the percentage of CD8+ T cells expressing A) CD69, B) CD25, and C) CD107a following incubation of BJ human fibroblasts cells for 24 hours with human PBMCs (10:1 effector to target cell ratio) and anti-FAP×anti-CD3 bsAbs in the 2+1 Fab2-scFv-Fc format with affinity de-matured FAP binding domains. The data show that bsAbs having lower affinity FAP-binding arms (for example, XENP28393, XENP28115, and XENP28116) were less potent in activating T cells than bsAbs having higher affinity FAP-binding arms (for example, XENP28114).

Figure 56:
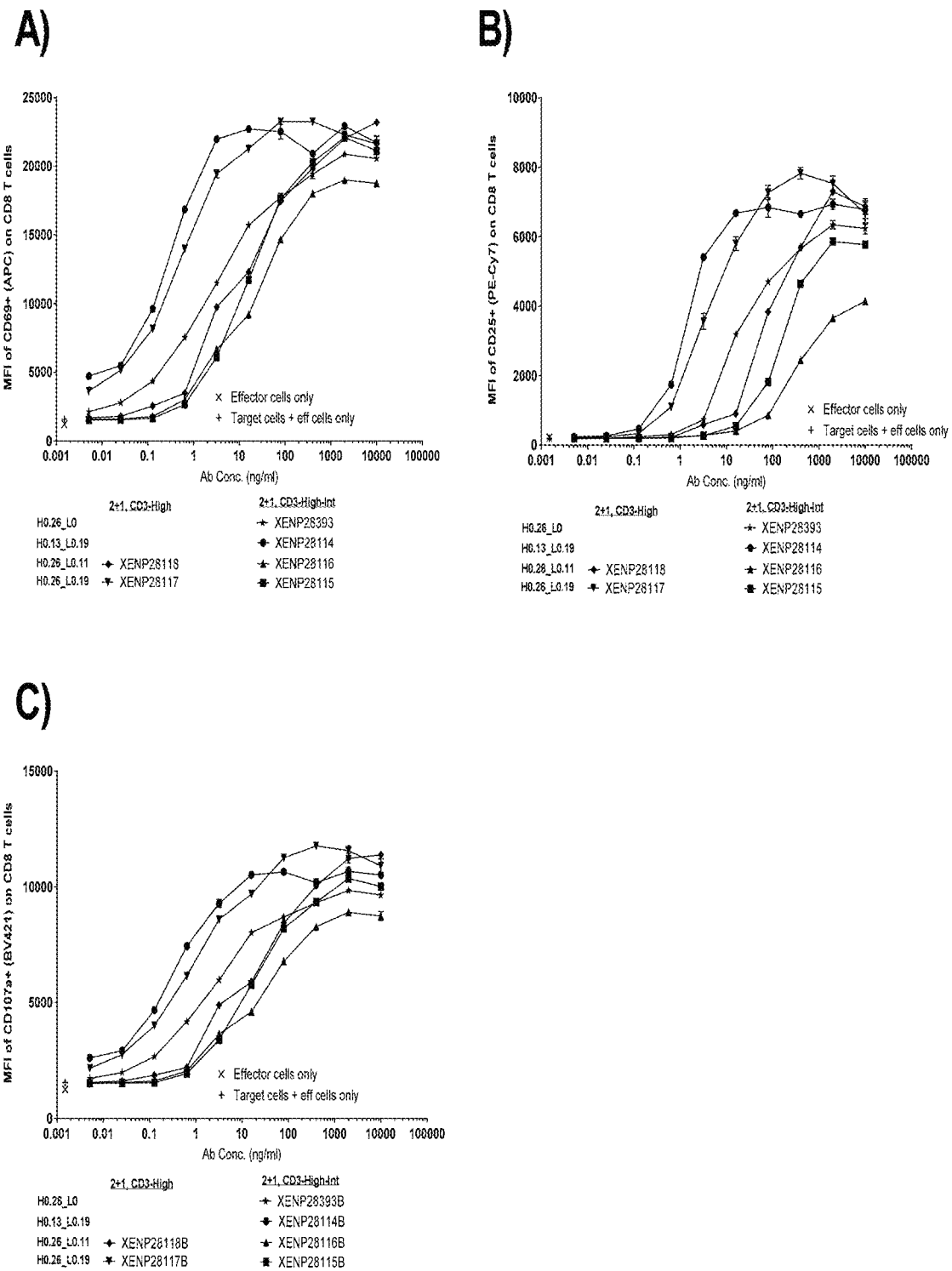

FIG. 56 depict the upregulation of A) CD69, B) CD25, and C) CD107a on CD8+ T cells (as indicated by MFI) following incubation of BJ human fibroblasts cells for 24 hours with human PBMCs (10:1 effector to target cell ratio) and anti-FAP×anti-CD3 bsAbs in the 2+1 Fab2-scFv-Fc format with affinity de-matured FAP binding domains.

Figure 57A:
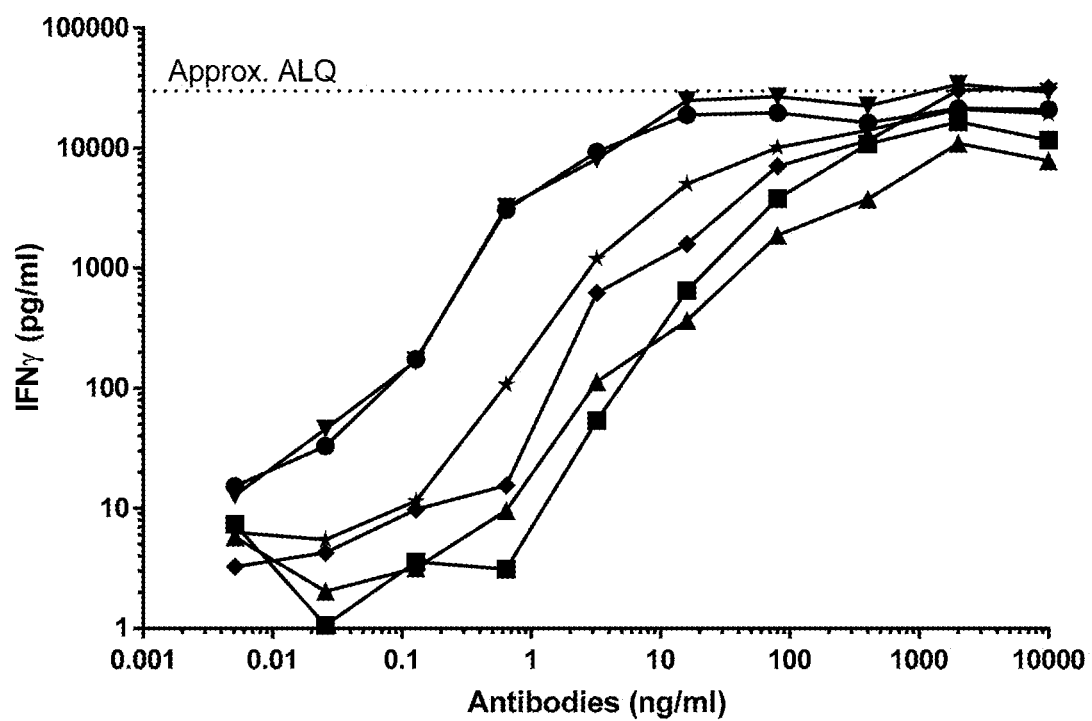
Figure 57B:
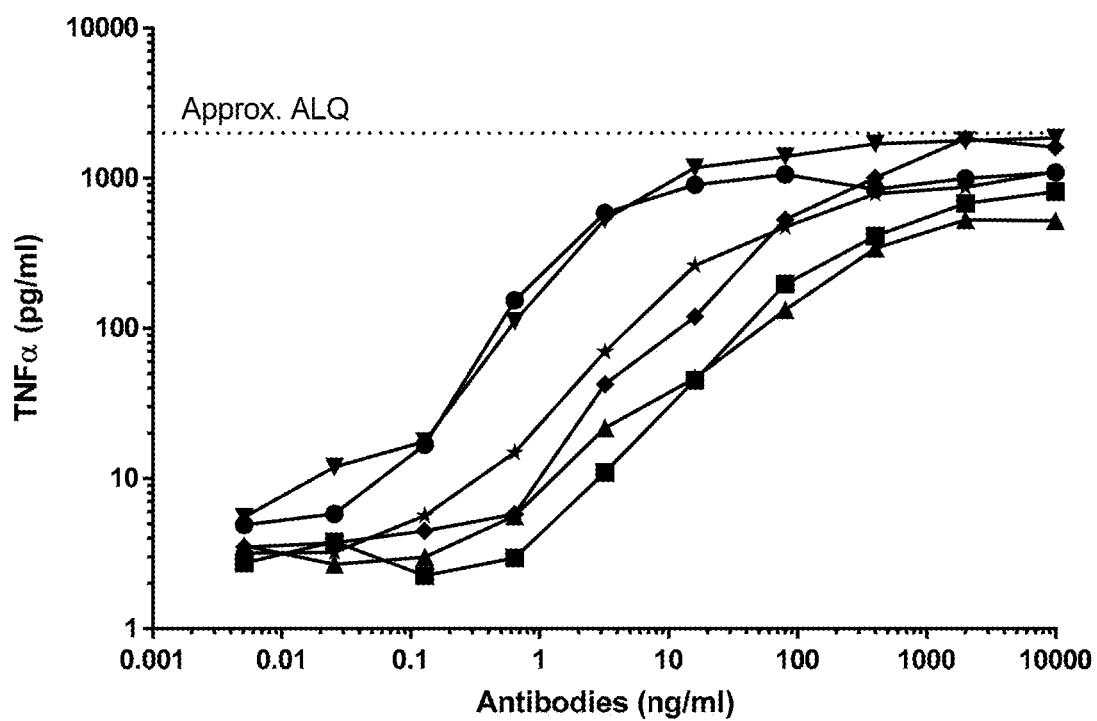
Figure 57C:
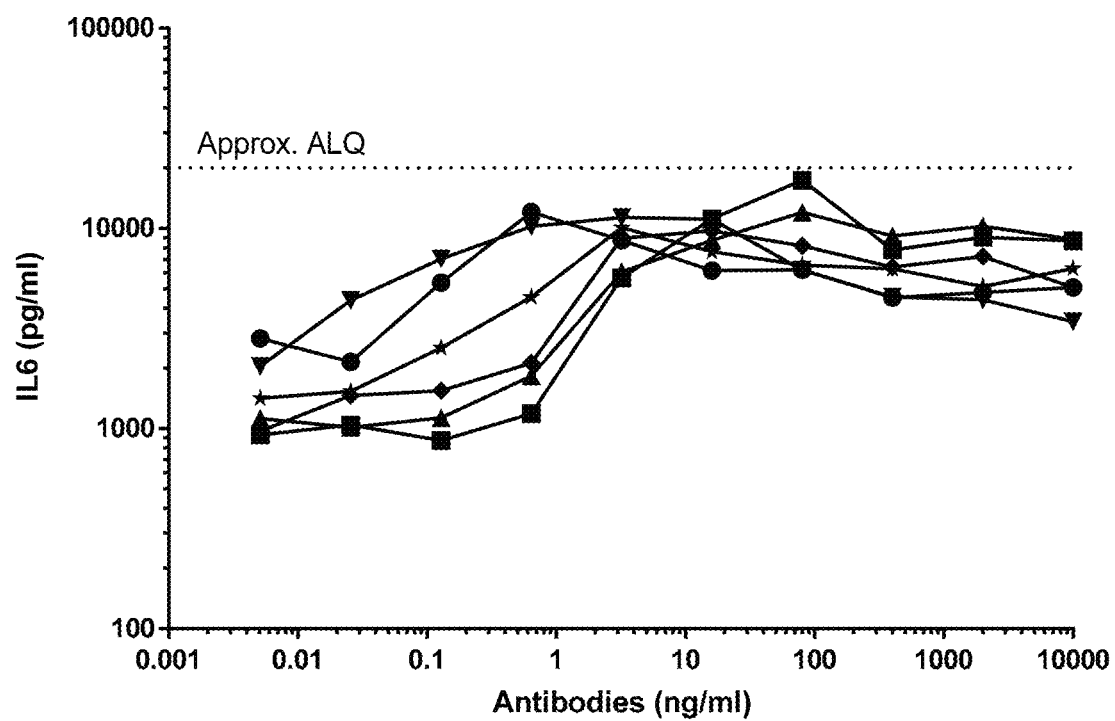

FIGS. 57A-57C depict concentration of A) IFNγ, B) TNFα, and C) IL-6 released by PBMCs incubated with BJ human fibroblasts cells for 24 hours (10:1 effector to target cell ratio) and anti-FAP×anti-CD3 bsAbs in the 2+1 Fab2-scFv-Fc format with affinity de-matured FAP binding domains.

FIG. 58 depicts the sequence for XENP24370, an in-house produced soluble human FAP.

Figure 59A:
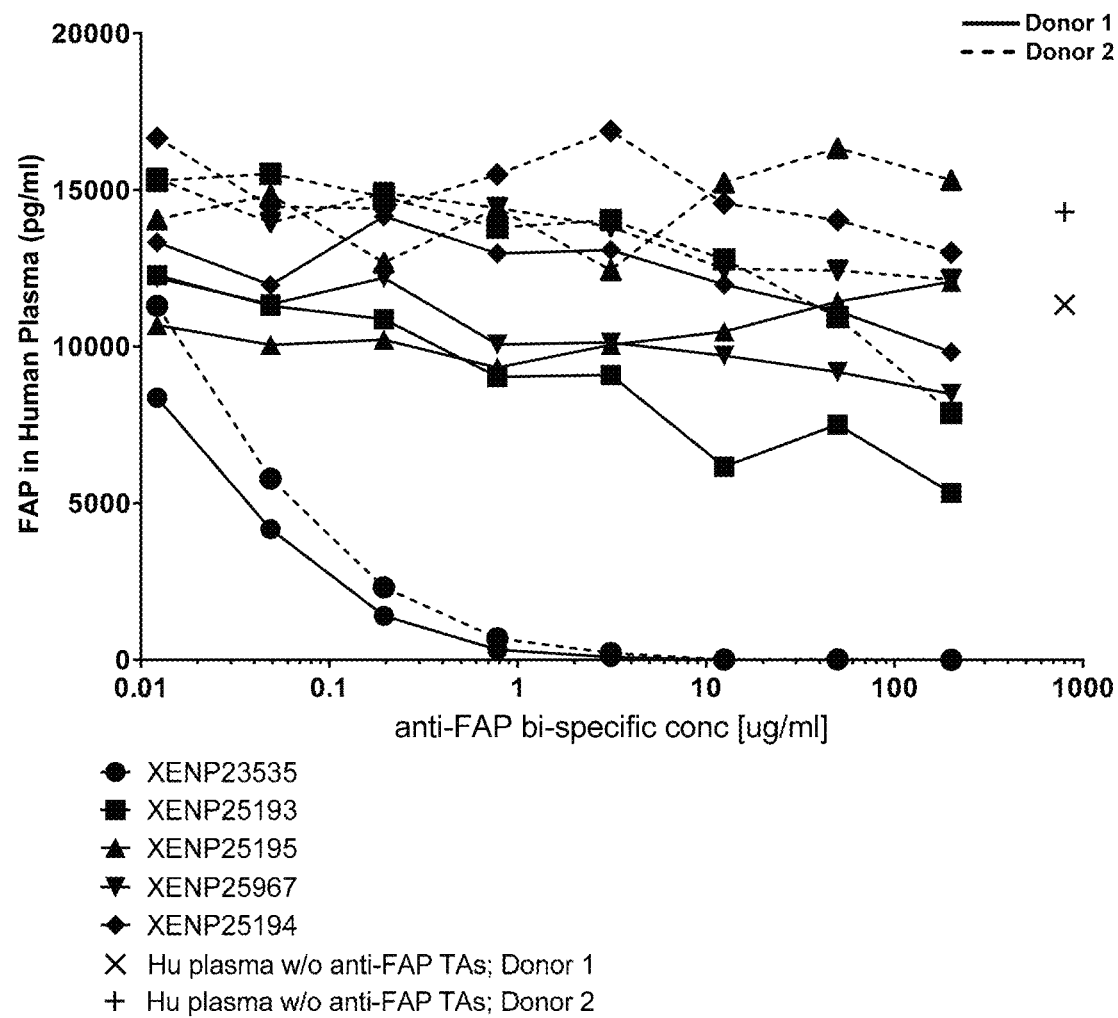
Figure 59B:
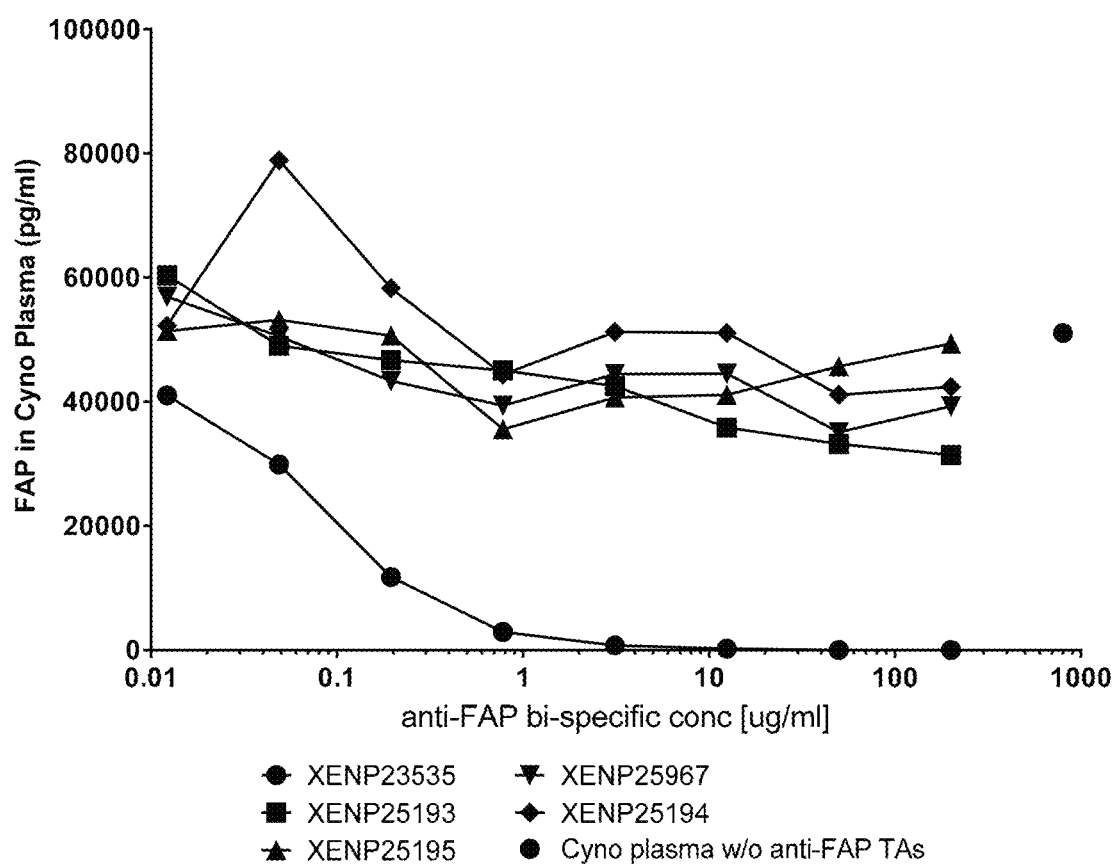

FIGS. 59A and 59B depict the concentration of soluble FAP in A) human plasma (from 2 donors) and B) cynomolgus plasma after incubation with an anti-FAP×anti-CD3 1+1 Fab-scFv-Fc bsAb (XENP23535) or anti-FAP×anti-CD3 2+1 Fab2-scFv-Fc bsAbs (XENP25193, XENP25195, XENP25967, and XENP25194).

Figure 60:
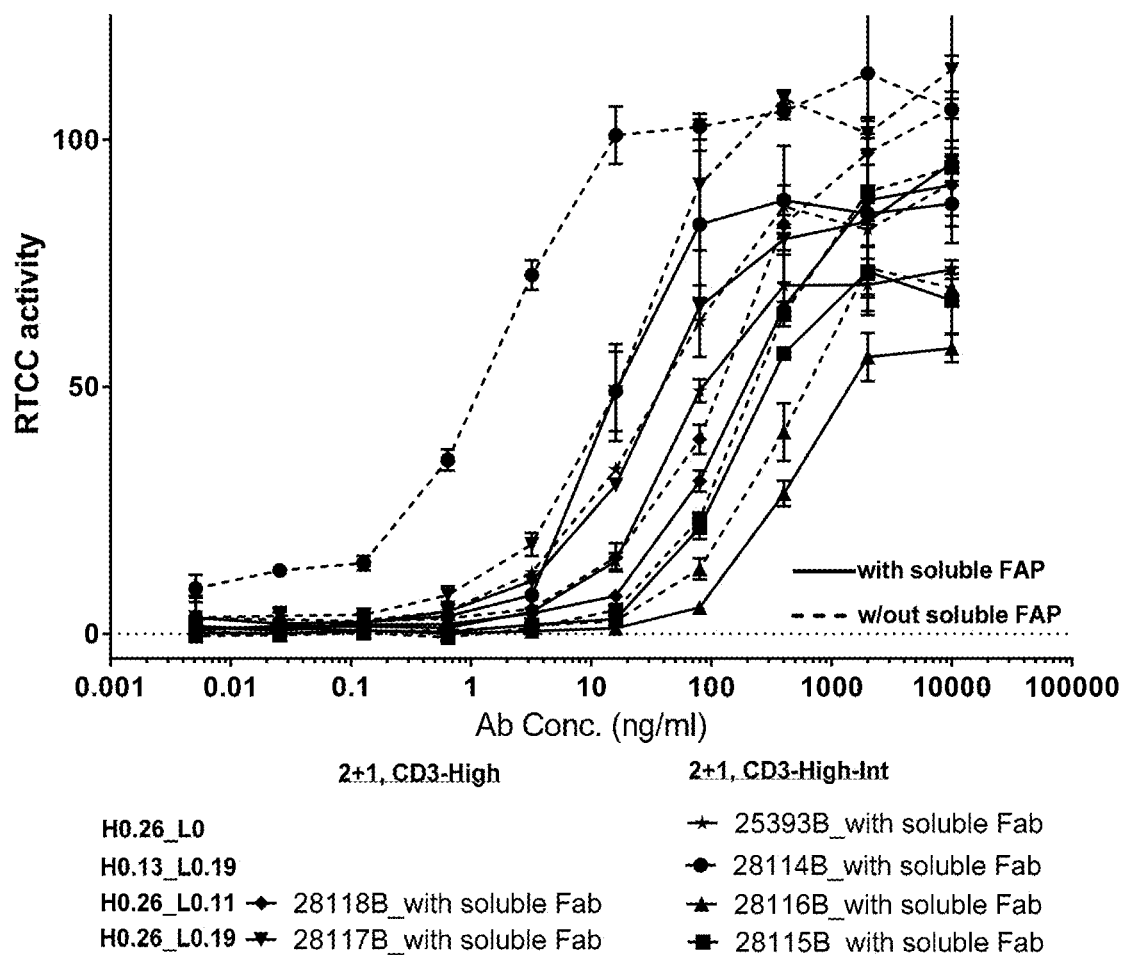

FIG. 60 depicts induction of RTCC on BJ human fibroblasts human PBMCs incubated with anti-FAP×anti-CD3 bsAbs in the 2+1 Fab2-scFv-Fc format with affinity de-matured FAP binding domains (additionally, with or without soluble FAP). The data show that bsAbs such as XENP28114 which has a high affinity FAP-binding arm demonstrated the greatest decrease in potency in the presence of soluble FAP, while the potency of bsAbs such as XENP28115 and XENP28116 having affinity de-matured FAP-binding arm were less impacted by the presence of soluble FAP.

Figure 61:
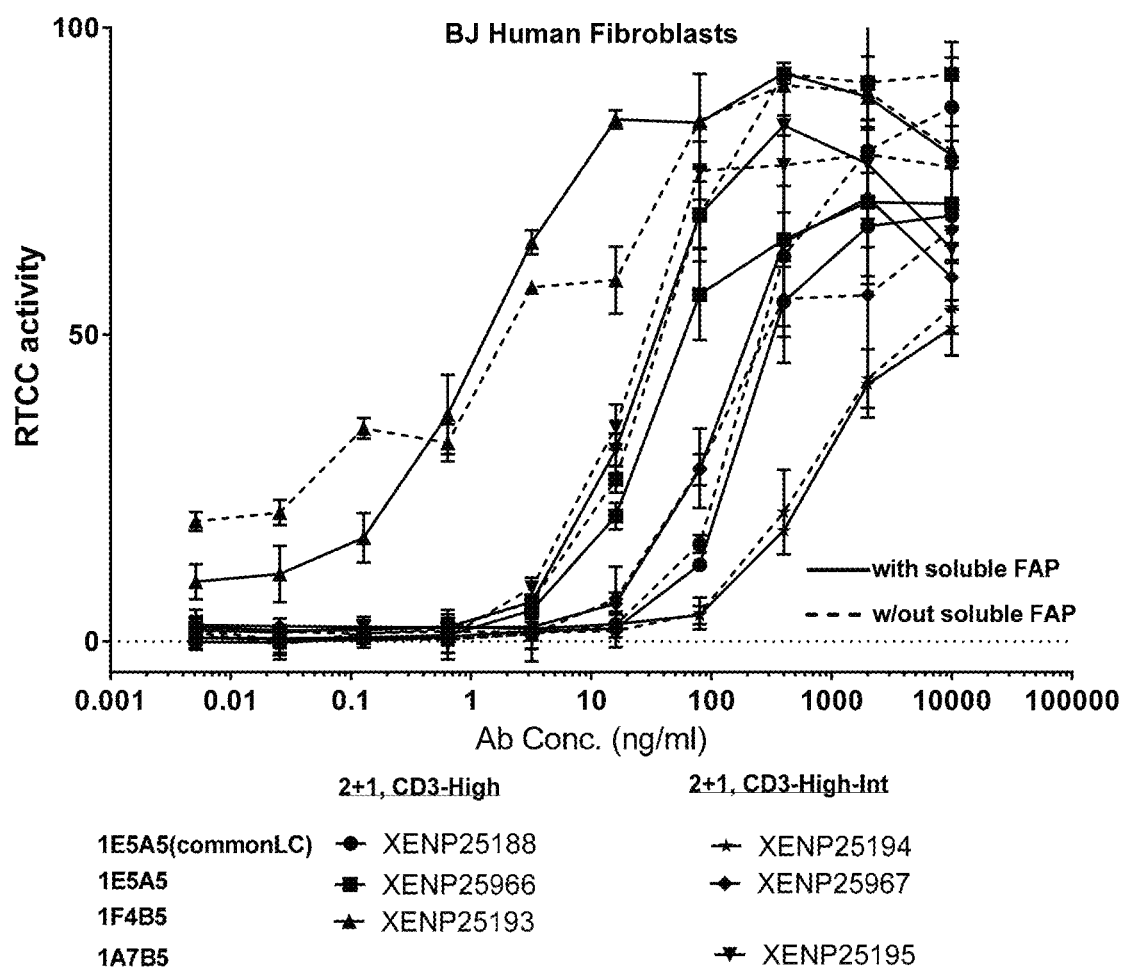

FIG. 61 depicts induction of RTCC on BJ human fibroblasts human PBMCs incubated with anti-FAP×anti-CD3 bsAbs in the 2+1 Fab2-scFv-Fc format with phage-derived FAP binding domains (additionally, with or without soluble FAP).

FIGS. 62A-62E depict the amino acid sequences of illustrative anti-FAP×anti-CD3 bispecific antibodies that include the M428L/N434S variants, which results in longer half-life in serum. The antibodies are named using the Fab variable region first and the Fab-scFv variable regions second, separated by a dash. CDRs are underlined and slashes indicate the border(s) of the variable regions. The scFv domain has orientation (N- to C-terminus) of VH-cFv linker-VL, although this can be reversed. In addition to these sequences, each of the sequences outlined herein can include or exclude the M428L/N434S variants in one or preferably both Fc domains.

FIG. 63A-63M depicts several useful 2+1 Fab2-scFv-Fc bispecific antibody format heavy chain backbones based on human IgG1, including scFvs for 6 different anti-CD3 ABDs, in both orientations, as well as sequences including and excluding the "XTEND®" FcRn variants 428L/434S (sometimes also referred to as "LS" variants) but excluding the ABDs for the other antigen. That is, Chain of each set is the -CH1-hinge-CH2-CH3 sequence (the "Fab-Fc side"), to which a VH1 sequence can be added (e.g. the C-terminus of the VH1 is joined at the slash "/") to form a full heavy chain, VH1-CH1-hinge-CH2-CH3. Chain 2 (also referred to herein as "monomer 2") of each set is the -anti-CD3 scFv-domain linker-CH2-CH3, to which a VH1-CH1-optional domain linker- is added (e.g. the C-terminus of the domain linker is joined at the slash "/"), to form the full chain (VH1-CH1-domain linker-scFv-domain linker-CH2-CH3). In this embodiment, the scFv can be in either orientation, such that the full chain is either VH1-CH1-domain linker-VH2-scFv linker-VL2-domain linker-CH2-CH3 or VH1-CH1-domain linker-VL2-scFv linker-VH2-domain linker-CH2-CH3 (note the sequences of FIG. 63 include both options). Chain 3 (also referred to herein as "light chain") is the LC domain, to which VL1 can be added to form VL1-CL. CDRs are underlined, linkers are double underlined, and domain borders are noted with a slash. It should be noted that all of the Chain 2 sequences include as the domain linker between the C-terminus of the scFv and the N-terminus of the CH2 domain the sequence GGGGSGGGGSKTHTCPPCP (SEQ ID NO:28), which is a "flexible half hinge" domain linker; however, this linker can be replaced in any FIG. 63 Chain 2 sequence with any of the "useful domain linkers" of FIG. 7, with some embodiments replacing the "flexible half hinge" with the "full hinge C220S variant" (EPKSSDKTHTCPPCP (SEQ ID NO:27). Each of these sequences include preferred skew, pI and ablation variants.

FIGS. 64A-64Q depicts exemplary subject FAP×CD3 bispecific antibodies in the 2+1 Fab2-scFv-Fc bispecific antibody format. Such antibodies include a) two Fabs that each include the VH and VL of FAP binding domain [αFAP]_H0.26_L0; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 65A-65Q depicts exemplary subject FAP×CD3 bispecific antibodies in the 2+1 Fab2-scFv-Fc bispecific antibody format. Such antibodies include a) two Fabs that each include the VH and VL of FAP binding domain [αFAP]_H0.26_L0.11; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 66A-66P depicts exemplary subject FAP×CD3 bispecific antibodies in the 2+1 Fab2-scFv-Fc bispecific antibody format. Such antibodies include a) two Fabs that each include the VH and VL of FAP binding domain [αFAP]_H0.26_L0.19; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 67A-67P depicts exemplary subject FAP×CD3 bispecific antibodies in the 2+1 Fab2-scFv-Fc bispecific antibody format. Such antibodies include a) two Fabs that each include the VH and VL of FAP binding domain 1A7B5 H1_L1; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 68A-68P depicts exemplary subject FAP×CD3 bispecific antibodies in the 2+1 Fab2-scFv-Fc bispecific antibody format. Such antibodies include a) two Fabs that each include the VH and VL of FAP binding domain 1E5A5 H1_L1; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 69A-69P depicts exemplary subject FAP×CD3 bispecific antibodies in the 2+1 Fab2-scFv-Fc bispecific antibody format. Such antibodies include a) two Fabs that each include the VH and VL of FAP binding domain 1E5A5 (common light chain) H1_L1 and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

FIGS. 70A-70P depicts exemplary subject FAP×CD3 bispecific antibodies in the 2+1 Fab2-scFv-Fc bispecific antibody format. Such antibodies include a) two Fabs that each include the VH and VL of FAP binding domain 1FAB5 H1_L1; and b) an scFv that includes the VH and VL of one of the following CD3 binding domains: H1.30_L1.47, H1.32_L1.47, H1.89_L1.47, H1.90_L1.47, H1.33_L1.47, H1.31_L1.47.

DETAILED DESCRIPTION

I. Overview

Fibroblasts represent a majority of stromal cells in the tumor environment. These cancer-associated fibroblasts (CAFs) have been reported to promote tumor survival and proliferation (Orimo et al., 2006; Xing et al., 2011), for example by providing growth factors for angiogenesis and by encouraging an immunosuppressive environment, and have been associated with poor prognosis (Underwood et al, 2015). Accordingly, there have been attempts to destroy tumors by targeting CAFs, although thus far, such treatments have been ineffective in clinical trials (Barnett and Vilar, 2018).

Fibroblast activation protein (FAP) is a serine protease involved in extracellular matrix remodeling (Kelly et al. 2012). FAP has been found to be highly expressed in CAFs (Scanlan et al., 1994). As FAP is elevated in cancer-associated fibroblasts, it is believed that anti-FAP antibodies are useful for treatment of cancers. In particular, provided herein are novel anti-CD3, anti-FAP bispecific antibodies. Such antibodies are used to direct CD3+ effector T cells to FAP+ sites, thereby allowing the CD3+ effector T cells to attack and lyse the FAP+ cells and tumors.

Provided herein are compositions that include FAP binding domains, including antibodies with such FAP binding domains (e.g., FAP×CD3 bispecific antibodies). Subject antibodies that include such FAP binding domains advantageously elicit a range of different immune responses, depending on the particular FAP binding domain used. For example, the subject antibodies exhibit differences in selectivity for cells with different FAP expression, potencies for FAP expressing cells, ability to elicit cytokine release, and sensitivity to soluble FAP. Such FAP binding domains and related antibodies find use, for example, in the treatment of FAP associated cancers.

Accordingly, in one aspect, provided herein are heterodimeric antibodies that bind to two different antigens, e.g., the antibodies are "bispecific", in that they bind two different target antigens, generally FAP and CD3 as described below. These heterodimeric antibodies can bind these target antigens either monovalently (e.g., there is a single antigen binding domain such as a variable heavy and variable light domain pair) or bivalently (there are two antigen binding domains that each independently bind the antigen). The heterodimeric antibodies provided herein are based on the use different monomers which contain amino acid substitutions that "skew" formation of heterodimers over homodimers, as is more fully outlined below, coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

II. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP25193, which is in 2+1 Fab2-scFv-Fc format, comprises three sequences (see FIG. 21E) a XENP025193 "Heavy Chain" monomer; 2) a XENP025193 "Fab-scFv-Fc Heavy Chain" monomer; and 3) a XENP025193 "Light Chain" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the Fab-scFv-Fc monomer has a full length sequence, a variable heavy sequence, 3 heavy CDR sequences, an scFv sequence (include scFv variable heavy sequence, scFv variable light sequence and scFv linker). Note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of anti-FAP binding domain 1A4A5 (e.g., FIG. 14A) is "H1_L1", which indicates that the variable heavy domain, H1, was combined with the light domain L1. In the case that these sequences are used as scFvs, the designation "H1_L1", indicates that the variable heavy domain, H1 is combined with the light domain, L1, and is in VH-linker-VL orientation, from N- to C-terminus. This molecule with the identical sequences of the heavy and light variable domains but in the reverse order (VL-linker-VH orientation, from N- to C-terminus) would be named "L1_H1.1". Similarly, different constructs may "mix and match" the heavy and light chains as will be evident from the sequence listing and the Figures.

III. Definitions

In order that the application may be more completely understood, several definitions are set forth below. Such definitions are meant to encompass grammatical equivalents.

By "Fibroblast Activation Protein" or "FAP" (e.g., Genebank Accession Number NP_004451.2 (human isoform 1) and NP_001278736.1 (human isoform 2); and NP_032012 (mouse)) herein is meant a homodimeric integral membrane gelatinase belonging to the serine protease family. FAP sequences are depicted, for example, in FIG. 2. FAP is highly expressed in the stromal fibroblast associated with epithelial cancers, granulation tissue of healing wounds, and malignant cells of bone and soft tissue sarcomas. FAP is involved in the control of fibroblast growth or epithelial-mesenchymal interactions during development, tissue repair, and epithelial carcinogenesis. The proteolytic activity of FAP supports tumor growth and proliferation.

By "CD3" or "cluster of differentiation 3" herein is meant a T-cell co-receptor that helps in activation of both cytotoxic T-cell (e.g., CD8+naïve T cells) and T helper cells (e.g., CD4+naïve T cells) and is composed of four distinct chains: one CD3γ chain (e.g., Genbank Accession Numbers NM_000073 and MP_000064 (human)), one CD3δ chain (e.g., Genbank Accession Numbers NM_000732, NM_001040651, NP_00732 and NP_001035741 (human)), and two CD3E chains (e.g., Genbank Accession Numbers NM_000733 and NP_00724 (human)). The chains of CD3 are highly related cell-surface proteins of the immunoglobulin superfamily containing a single extracellular immunoglobulin domain. The CD3 molecule associates with the T-cell receptor (TCR) and ζ-chain to form the T-cell receptor (TCR) complex, which functions in generating activation signals in T lymphocytes.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. (See Table 2 and related discussion above for CDR numbering schemes). Thus, in some cases, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 1). In general, the C-terminus of the scFv domain is attached to the N-terminus of the hinge in the second monomer.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233 #, E233( ) or E233del designates a deletion of glutamic acid at position 233. Additionally, EDA233- or EDA233 #designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, N434S/M428L is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). See also Edelman et al., 1969, Proc Natl Acad Sci USA 63:78-85, hereby entirely incorporated by reference. The modification can be an addition, deletion, or substitution.

"Variant" as used herein also refers to particular amino acid modifications (e.g., a "heterodimerization variant," "pI variant," "ablation variant," etc.).

By "protein" as used herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains, generally on two different polypeptide chains (e.g., VH-CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the vl and vh domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g., H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is an amino acid modification that contributes to increased binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
| --- | --- | --- |
| CH1 | 118-215 | 114-223 |
| Hinge | 216-230 | 226-243 |
| CH2 | 231-340 | 244-360 |
| CH3 | 341-447 | 361-478 |

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference). The modification can be an addition, deletion, or substitution.

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains herein still retain the ability to form a dimer with another Fc domain as measured using known techniques as described herein, such as non-denaturing gel electrophoresis.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

By "position" as used herein is meant a location in the sequence of a protein. Positions may be numbered sequentially, or according to an established format, for example the EU index for numbering of antibody domains (e.g., a CH1, CH2, CH3 or hinge domain).

By "target antigen" as used herein is meant the molecule that is bound specifically by the antigen binding domain comprising the variable regions of a given antibody. As discussed below, in the present case the target antigens are checkpoint inhibitor proteins.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogenous nucleic acids encoding the components of the bispecific antibody and is capable of expressing the bispecific antibody under suitable conditions. Suitable host cells are discussed below.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "wild type or WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains (e.g., Fc domains) that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, CD. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogenous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

IV. FAP Antigen Binding Domains

In one aspect, provided herein are FAP antigen binding domains (ABDs) and compositions that include such FAP antigen binding domains (ABDs). The FAP binding domains provided herein exhibit a wide degree of affinity for FAP (see, e.g., FIGS. 45-49). Subject antibodies that include such FAP binding domains (e.g., FAP×CD3 bispecific antibodies) advantageously elicit a range of different immune responses, depending on the particular FAP binding domain and number of the binding domains included in such antibodies. For example, the subject antibodies exhibit differences in selectivity for cells with different FAP expression, potencies for FAP expressing cells, ability to elicit cytokine release, and sensitivity to soluble FAP (see, e.g., Examples 6-8). Such FAP binding domains and related antibodies find use, for example, in the treatment of FAP associated cancers.

As will be appreciated by those in the art, suitable FAP binding domains can comprise a set of 6 CDRs as depicted in the Sequence Listing and figures, either as they are underlined or, in the case where a different numbering scheme is used as described herein and as shown in Table 2, as the CDRs that are identified using other alignments within the variable heavy (VH) domain and variable light domain (VL) sequences of those depicted in FIGS. 14 and 45 and the Sequence Listing. Suitable FAP ABDs can also include the entire VH and VL sequences as depicted in these sequences and figures, used as scFvs or as Fabs.

In one embodiment, the FAP antigen binding domain includes the 6 CDRs (i.e., vhCDR1-3 and vlCDR1-3) of any of the FAP binding domains described in FIG. 13-15, 45, 51 or 62 or the Sequence Listing.

In addition to the parental CDR sets disclosed in the figures and sequence listing that form an ABD to FAP, provided herein are variant FAP ABDS having CDRs that include at least one modification of the FAP ABD CDRs disclosed herein (e.g., FIG. 13-15, 45, 51 or 62 or the Sequence Listing). In one embodiment, the FAP ABD includes a set of 6 CDRs with 1, 2, 3, 4, 5, 6, 7, 8, 9, 10 amino acid modifications as compared to the 6 CDRs of a FAP ABD as depicted in FIG. 13-15, 45, 51 or 62 or the Sequence Listing. In certain embodiments, the FAP ABD is capable of binding FAP antigen, as measured by at least one of a Biacore, surface plasmon resonance (SPR) and/or BLI (biolayer interferometry, e.g., Octet assay) assay, with the latter finding particular use in many embodiments.

In one embodiment, the FAP ABD includes 6 CDRs that are at least 90, 95, 97, 98 or 99% identical to the 6 CDRs of a FAP ABD as depicted in FIG. 13-15, 45, 51 or 62 or the Sequence Listing. In certain embodiments, the FAP ABD is capable of binding to the FAP, as measured by at least one of a Biacore, surface plasmon resonance (SPR) and/or BLI (biolayer interferometry, e.g., Octet assay) assay, with the latter finding particular use in many embodiments.

In one embodiment, the FAP antigen binding domain includes the 6 CDRs (i.e., vhCDR1-3 and vlCDR1-3) of a FAP ABD, wherein the FAP ABD is one of the following FAP ABDs: 1A4A5 H1_L1; 1C3A5 H1_L1; 1E5A5 H1_L1; 1E5A5 (common light chain) H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In one embodiment, the FAP antigen binding domain is a variant FAP antigen binding domain that includes 6 CDRs (i.e., vhCDR1-3 and vlCDR1-3), where the 6 CDRs include 1, 2, 3, 4, 5, 6, 7, 8, 9, or 10 modifications as compared to the 6 CDRs of one of the following FAP ABDs: 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7);

XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In one embodiment, the FAP antigen binding domain is a variant FAP antigen binding domain that includes 6 CDRs (i.e., vhCDR1-3 and vlCDR1-3), where the 6 CDRs are at least 90, 95, 97, 98 or 99% identical as compared to the 6 CDRs of one of the following FAP ABDs: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In another exemplary embodiment, the FAP ABD include the variable heavy (VH) domain and variable light (VL) domain of any one of the FAP ABDs disclosed in the FIG. 13-15, 45, 51 or 62 or the Sequence Listing.

In addition to the parental FAP variable heavy and variable light domains disclosed herein, provided herein are FAP ABDs that include a variable heavy domain and/or a variable light domain that are variants of a FAP ABD VH and VL domain disclosed herein.

In one embodiment, the variant VH domain and/or VL domain has from 1, 2, 3, 4, 5, 6, 7, 8, 9 or 10 amino acid changes from a VH and/or VL domain of a FAP ABD depicted in FIG. 13-15, 45, 51 or 62 or the Sequence Listing. In certain embodiments, the FAP ABD is capable of binding to FAP, as measured at least one of a Biacore, surface plasmon resonance (SPR) and/or BLI (biolayer interferometry, e.g., Octet assay) assay, with the latter finding particular use in many embodiments.

In one embodiment, the variant VH and/or VL domain is at least 90, 95, 97, 98 or 99% identical to the VH and/or VL of a FAP ABD as depicted in FIG. 13-15, 45, 51 or 62 or the Sequence Listing. In certain embodiments, the FAP ABD is capable of binding to the FAP, as measured by at least one of a Biacore, surface plasmon resonance (SPR) and/or BLI (biolayer interferometry, e.g., Octet assay) assay, with the latter finding particular use in many embodiments.

In some embodiments, the FAP ABD includes the VH and VL of one of the following FAP ABDs: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1);

XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In some embodiments, the FAP ABD includes a VH and VL, where the VH and/or VL includes 1, 2, 3, 4, 5, 6, 7, 8, 9 or 10 amino acid modifications as compared to a VH and/or VL of one of the following FAP ABDs disclosed herein: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In certain embodiments, the FAP ABD includes a VH and VL, where the VH and VL are at least 90, 95, 97, 98 or 99% identical as compared to a VH and VL of one of the following FAP ABDs disclosed herein: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36);

XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

V. Anti-FAP Antibodies

In one aspect, provided herein are antibodies that bind to FAP (e.g., anti-FAP antibodies). In certain embodiments, the antibody binds to human FAP (FIG. 2). Subject anti-FAP antibodies include monospecific FAP antibodies, as well as multi-specific (e.g., bispecific) anti-FAP antibodies. In certain embodiments, the anti-FAP antibody has a format according to any one of the antibody formats depicted in FIG. 1.

In some embodiments, the subject compositions include a FAP binding domain. In some embodiments, the composition includes an antibody having FAP binding domain. Antibodies provided herein include one, two, three, four, and five or more FAP binding domains. In certain embodiments, the FAP binding domain includes any one of the vhCDR1, vhCDR2, vhCDR3, vlCDR1, vlCDR2 and vlCDR3 sequences of an FAP binding domain selected from those depicted in FIGS. 13-15, 45, 51 and 62. In some embodiments, the FAP binding domain includes the underlined vhCDR1, vhCDR2, vhCDR3, vlCDR1, vlCDR2 and vlCDR3 sequences of a FAP binding domain selected from those depicted in FIGS. 13-15, 45, 51 and 62. In some embodiments, the FAP binding domain includes the variable heavy domain and variable light domain of a FAP binding domain selected from those depicted in FIGS. 13-15, 45, 51 and 62. FAP binding domains depicted in FIGS. 13-15, 45, 51 and 62 include 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41).

In some embodiments, the antibody is a bispecific antibody that binds FAP and CD3. Such antibodies include a CD3 binding domain and at least one FAP binding domain. Any suitable FAP binding domain can be included in the anti-FAP×anti-CD3 bispecific antibody. In some embodiments, the anti-FAP×anti-CD3 bispecific antibody includes one, two, three, four or more FAP binding domains, including but not limited to those depicted in FIGS. 13-15, 45, 51 and 62. In certain embodiments, the anti-FAP×anti-CD3 antibody includes a FAP binding domain that includes the vhCDR1, vhCDR2, vhCDR3, vlCDR1, vlCDR2 and vlCDR3 sequences of a FAP binding domain selected from the group consisting of those depicted in FIGS. 13-15, 45, 51 and 62. In some embodiments, the anti-FAP×anti-CD3 antibody includes a FAP binding domain that includes the underlined vhCDR1, vhCDR2, vhCDR3, vlCDR1, vlCDR2 and vlCDR3 sequences of a FAP binding domain selected from a FAP binding domain depicted in FIGS. 13-15, 45, 51 and 62. In some embodiments, the anti-FAP×anti-CD3 antibody includes a FAP binding domain that includes the variable heavy domain and variable light domain of a FAP binding domain selected from the FAP binding domains depicted in FIGS. 13-15, 45, 51 and 62.

The anti-FAP×anti-CD3 antibody provided herein can include any suitable CD3 binding domain. In certain embodiments, the anti-FAP×anti-CD3 antibody includes a CD3 binding domain that includes the vhCDR1, vhCDR2, vhCDR3, vlCDR1, vlCDR2 and vlCDR3 sequences of a CD3 binding domain selected from the group consisting of those depicted in FIGS. 14 and 15. In some embodiments, the anti-FAP×anti-CD3 antibody includes a CD3 binding domain that includes the underlined vhCDR1, vhCDR2, vhCDR3, vlCDR1, vlCDR2 and vlCDR3 sequences of a CD3 binding domain selected from the group consisting of those depicted in FIGS. 14 and 15. In some embodiments, the FAP×CD3 antibody includes a CD3 binding domain that includes the variable heavy domain and variable light domain of a CD3 binding domain selected from the group consisting of those depicted in FIG. 12. In some embodiments, the CD3 binding domain is selected from anti-CD3 H1.30_L1.47, anti-CD3 H1.32_L1.47; anti-CD3

H1.89_L1.48; anti-CD3 H1.90_L1.47; Anti-CD3 H1.33_L1.47; and anti-CD3 H1.31_L1.47.

As used herein, term "antibody" is used generally. Antibodies that find use in the present invention can take on a number of formats as described herein, including traditional antibodies as well as antibody derivatives, fragments and mimetics, described herein.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the antibodies herein have at least one the cysteines at position 220 according to EU numbering (hinge region) replaced by a serine. Generally, this modification is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention includes the use of human IgG1/G2 hybrids.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g., residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., Dev. Comp. Immunol. 27(1):55-77 (2003):

TABLE 2

|  | Kabat + Chothia | IMGT | Kabat | AbM | Chothia | Contact | Xencor |
| --- | --- | --- | --- | --- | --- | --- | --- |
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region.

The antigen binding domains and antibodies provided herein include a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the antigen binding domains and antibodies provided herein include different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the -CH2-CH3 domain, and optionally a hinge domain (-hinge-CH2-CH3). In the embodiments herein, when a scFv is attached to an Fc domain, it is the C-terminus of the scFv construct that is attached to the Fc domain by a linker (e.g., a hinge, a partial hinge or any of the "useful domain linkers" included in FIG. 7). The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In some embodiments of the scFvs outlined herein, the C-terminus of the scFv variable heavy chain is attached to the N-terminus of the scFv linker, the C-terminus of which is attached to the N-terminus of the scFv variable light chain (N-VH-linker-VL-C). In other embodiments of the scFvs provided herein, the C-terminus of the scFv variable light chain is attached to the N-terminus of the scFv linker, the C-terminus of which is attached to the N-terminus of the scFv variable heavy chain (N-VL-linker-VH-C).

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format (see generally FIG. 1).

As shown herein, there are a number of suitable linkers (for use as either domain linkers or scFv linkers) that can be used to covalently attach the recited domains (e.g., scFvs, Fabs, Fc domains, etc.), including traditional peptide bonds, generated by recombinant techniques. Exemplary linkers to attach domains of the subject antibody to each other are depicted in FIG. 7. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 1176), (GGGGS)n (SEQ ID NO: 1177), and (GGGS)n (SEQ ID NO: 1178), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the linker is a "domain linker", used to link any two domains as outlined herein together. For example, in FIG. 1F, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 1176), (GGGGS)n (SEQ ID NO: 1177), and (GGGS)n (SEQ ID NO: 1178), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker that is used to covalently attach the VH and VL domains as discussed herein. In many cases, the scFv linker is a charged scFv linker, a number of which are shown in FIG. 7.

Accordingly, provided herein are charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make 1+1 Fab-scFv-Fc format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 7 can be used in any embodiment herein where a linker is utilized.

In particular, the formats depicted in FIG. 1 are antibodies, usually referred to as "heterodimeric antibodies", meaning that the protein has at least two associated Fc sequences self-assembled into a heterodimeric Fc domain and at least two Fv regions, whether as Fabs or as scFvs.

A. Chimeric and Humanized Antibodies

In certain embodiments, the subject antibodies provided herein include a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

B. Heterodimeric Antibodies

Provided herein are heterodimeric antibodies that include two variant Fc domain sequences. Such variant Fc domains include amino acid modifications to facilitate the self-assembly and/or purification of the heterodimeric antibodies.

In some embodiments, the heterodimeric antibody is a bispecific (i.e., binds to two different antigens) antibody that include a FAP binding domain. In some embodiments, the heterodimeric bispecific antibody is an anti-FAPxanti-CD3 bispecific antibody.

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in biasing the formation of the desired heterodimeric antibody over the formation of the homodimers and/or purifying the heterodimeric antibody away from the homodimers.

There are a number of mechanisms that can be used to generate the subject heterodimeric antibodies. In addition, as will be appreciated by those in the art, these different mechanisms can be combined to ensure high heterodimerization. Amino acid modifications that facilitate the production and purification of heterodimers are collectively referred to generally as "heterodimerization variants." As discussed below, heterodimerization variants can include "skew" variants (e.g., the "knobs and holes" and the "charge pairs" variants described below) as well as "pI variants," which allow purification of heterodimers from homodimers. As is generally described in U.S. Pat. No. 9,605,084, hereby incorporated by reference in its entirety and specifically as below for the discussion of heterodimerization variants, useful mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat.

No. 9,605,084, and general additional Fc variants as outlined in U.S. Pat. No. 9,605,084 and below.

Heterodimerization variants that are useful for the formation and purification of the subject heterodimeric antibody (e.g., bispecific antibodies) are further discussed in detailed below. 1. Skew Variants In some embodiments, the heterodimeric anti-FAP antibody includes skew variants which are one or more amino acid modifications in a first Fc domain (A) and/or a second Fc domain (B) that favor the formation of Fc heterodimers (Fc dimers that include the first and the second Fc domain; (A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIGS. 3 and 6.

One particular type of skew variants is generally referred to in the art as "knobs and holes," referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety and specifically for the disclosure of "knobs and holes" mutations. This is sometime referred to herein as "steric variants." The figures identify a number of "monomer A-monomer B" pairs that rely on "knobs and holes". In addition, as described in Merchant et al., Nature Biotech. 16:677 (1998), these "knobs and holes" mutations can be combined with disulfide bonds to further favor formation of Fc heterodimers.

Another method that finds use in the generation of heterodimers is sometimes referred to as "electrostatic steering" as described in Gunasekaran et al., J. Biol. Chem. 285(25): 19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "skew variants". These include, but are not limited to, D221E/P228E/L368E paired with D221R/P228R/K409R (e.g., these are "monomer corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric anti-FAP antibody includes one or more sets of such heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25% homodimer A/A:50% heterodimer A/B:25% homodimer B/B). Exemplary heterodimerization "skew" variants are depicted in FIG. 4.

In exemplary embodiments, the heterodimeric anti-FAP antibody includes a S364K/E357Q:L368D/K370S; L368D/K370S:S364K; L368E/K370S:S364K; T411T/E360E/Q362E:D401K; L368D/K370S:S364K/E357L; K370S:S364K/E357Q; or a T366S/L368A/Y407V:T366W (optionally including a bridging disulfide, T366S/L368A/Y407V/Y349C:T366W/S354C) "skew" variant amino acid substitution set. In an exemplary embodiment, the heterodimeric anti-FAP antibody includes a "S364K/E357Q:L368D/K370S" amino acid substitution set. In terms of nomenclature, the pair "S364K/E357Q:L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotpypic variants, FcRn variants, ablation variants, etc. into one or both of the first and second Fc domains of the heterodimeric anti-FAP antibody. Further, individual modifications can also independently and optionally be included or excluded from the subject the heterodimeric anti-FAP antibody.

In some embodiments, the skew variants outlined herein can be optionally and independently incorporated with any pI variant (or other variants such as Fc variants, FcRn variants, etc.) into one or both heavy chain monomers, and can be independently and optionally included or excluded from the subject heterodimeric antibodies.

2. pI (Isoelectric Point) Variants for Heterodimers

In some embodiments, the heterodimeric anti-FAP antibody includes purification variants that advantageously allow for the separation of heterodimeric anti-FAP antibody from homodimeric proteins.

There are several basic mechanisms that can lead to ease of purifying heterodimeric antibodies. For example, modifications to one or both of the antibody heavy chain monomers A and B such that each monomer has a different pI allows for the isoelectric purification of heterodimeric A-B antibody from monomeric A-A and B-B proteins. Alternatively, some scaffold formats, such as the "1+1 Fab-scFv-Fc" format and the "2+1 Fab2-scFv-Fc" format, also allows separation on the basis of size. As described above, it is also possible to "skew" the formation of heterodimers over homodimers using skew variants. Thus, a combination of heterodimerization skew variants and pI variants find particular use in the heterodimeric antibodies provided herein.

Additionally, as more fully outlined below, depending on the format of the heterodimeric antibody, pI variants either contained within the constant region and/or Fc domains of a monomer, and/or domain linkers can be used. In some embodiments, the heterodimeric antibody includes additional modifications for alternative functionalities that can also create pI changes, such as Fc, FcRn and KO variants.

In some embodiments, the subject heterodimeric antibodies provided herein include at least one monomer with one or more modifications that alter the pI of the monomer (i.e., a "pI variant"). In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Depending on the format of the heterodimer antibody, pI variants can be either contained within the constant and/or Fc domains of a monomer, or charged linkers, either domain linkers or scFv linkers, can be used. That is, antibody formats that utilize scFv(s) such as "1+1 Fab-scFv-Fc", format can include charged scFv linkers (either positive or negative), that give a further pI boost for purification purposes. As will be appreciated by those in the art, some 1+1 Fab-scFv-Fc formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In subject heterodimeric antibodies that utilizes pI as a separation mechanism to allow the purification of heterodimeric proteins, amino acid variants are introduced into one or both of the monomer polypeptides. That is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (aspartic acid to lysine) or changing a charged residue to a neutral residue (e.g., loss of a charge; lysine to serine.). A number of these variants are shown in the FIGS. 3 and 4.

Thus, in some embodiments, the subject heterodimeric antibody includes amino acid modifications in the constant regions that alter the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the 1+1 Fab-scFv-Fc format, the starting pI of the scFv and Fab of interest. That is, to determine which monomer to engineer or in which "direction" (e.g., more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and pI heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

A side benefit that can occur with this pI engineering is also the extension of serum half-life and increased FcRn binding. That is, as described in US Publ. App. No. US 2012/0028304 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

In general, embodiments of particular use rely on sets of variants that include skew variants, which encourage heterodimerization formation over homodimerization formation, coupled with pI variants, which increase the pI difference between the two monomers to facilitate purification of heterodimers away from homodimers.

Exemplary combinations of pI variants are shown in FIGS. 4 and 5, and FIG. 30 of US Publ. App. No. 2016/0355608, all of which are herein incorporated by reference in its entirety and specifically for the disclosure of pI variants. Preferred combinations of pI variants are shown in FIGS. 3 and 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIGS. 1A, E, F, G, H and I formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 4). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one armed" format such as those depicted in FIG. 1B, C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIG. 7).

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., an IL-7-Fc fusion protein may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389, 392, 397, 418, 419, 444 and 447 (EU numbering) of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447. 3. Isotypic Variants In addition, many embodiments of the subject heterodimeric antibodies rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

4. Calculating pI

The pI of each monomer of the antibodies provided herein can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

5. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

C. Additional Fc Variants for Additional Functionality

In addition to the heterodimerization variants discussed above, there are a number of useful Fc amino acid modification that can be made for a variety of reasons, including, but not limited to, altering binding to one or more FcγR receptors, altered binding to FcRn receptors, etc, as discussed below.

Accordingly, the antibodies provided herein (heterodimeric, as well as homodimeric) can include such amino acid modifications with or without the heterodimerization variants outlined herein (e.g., the pI variants and steric variants). Each set of variants can be independently and optionally included or excluded from any particular heterodimeric protein.

1. FcγR Variants

Accordingly, there are a number of useful Fc substitutions that can be made to alter binding to one or more of the FcγR receptors. In certain embodiments, the subject antibody includes modifications that alter the binding to one or more FcγR receptors (i.e., "FcγR variants"). Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the subject antibodies include those listed in U.S. Pat. No. 8,188,321 (particularly FIG. 41) and U.S. Pat. No. 8,084,582, and US Publ. App. Nos. 20060235208 and 20070148170, all of which are expressly incorporated herein by reference in their entirety and specifically for the variants disclosed therein that affect Fcγ receptor binding. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T. Such modification may be included in one or both Fc domains of the subject antibody.

In some embodiments, the subject antibody includes one or more Fc modifications that increase serum half-life. Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L. Such modification may be included in one or both Fc domains of the subject antibody.

2. Ablation Variants

In some embodiments, the anti-FAP antibody includes one or more modifications that reduce or remove the normal binding of the Fc domain to one or more or all of the Fcγ receptors (e.g., FcγR1, FcγRIIa, FcγRIIb, FcγRIIIa, etc.) to avoid additional mechanisms of action. Such modifications are referred to as "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific antibodies that bind CD3 monovalently, it is generally desirable to ablate FcγRIIIa binding to eliminate or significantly reduce ADCC activity. In some embodiments, of the subject antibodies described herein, at least one of the Fc domains comprises one or more Fcγ receptor ablation variants. In some embodiments, of the subject antibodies described herein, both of the Fc domains comprises one or more Fcγ receptor ablation variants. These ablation variants are depicted in FIG. 5, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

D. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Exemplary combination of variants that are included in some embodiments of the heterodimeric 1+1 Fab-scFv-Fc and 2+1 Fab2-scFv-Fc format antibodies are included in FIG. 6. In some embodiments, the heterodimeric antibody includes a combination of variants as depicted in FIG. 6. in certain embodiments, the antibody is a heterodimeric 1+1 Fab-scFv-Fc or 2+1 Fab2-scFv-Fc format antibodies E. Useful Antibody Formats As will be appreciated by those in the art and discussed more fully below, the heterodimeric fusion proteins of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats of the invention can have different valencies as well as be bispecific. That is, heterodimeric antibodies of the invention can be bivalent and bispecific, wherein one target tumor antigen (e.g., CD3) is bound by one binding domain and the other target tumor antigen (e.g., FAP) is bound by a second binding domain. The heterodimeric antibodies can also be trivalent and bispecific, wherein the first antigen is bound by two binding domains and the second antigen by a second binding domain. As is outlined herein, when CD3 is one of the target antigens, it is preferable that the CD3 is bound only monovalently, to reduce potential side effects.

The present invention utilizes CD3 antigen binding domains in combination with FAP binding domains. As will be appreciated by those in the art, any collection of anti-CD3 CDRs, anti-CD3 variable light and variable heavy domains, Fabs and scFvs as depicted in any of the figures (see particularly FIG. 12) can be used. Similarly, any of the anti-FAP antigen binding domains can be used, whether CDRs, variable light and variable heavy domains, Fabs and scFvs as depicted in any of the Figures (e.g., FIGS. 13-15) can be used, optionally and independently combined in any combination.

1. 2+1 Fab2-scFv-Fc format (Central-scFv format)

Figure 1B:
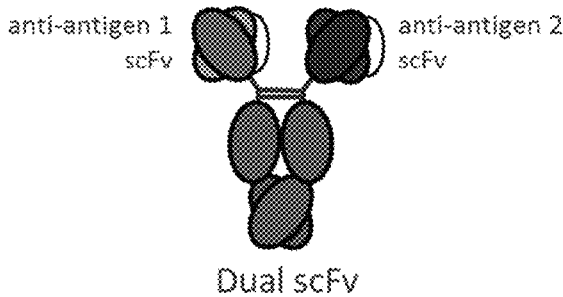
Figure 1C:
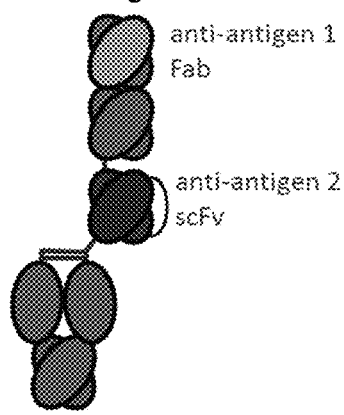
Figure 1D:
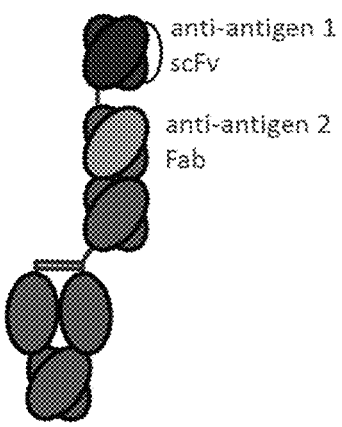
Figure 1E:
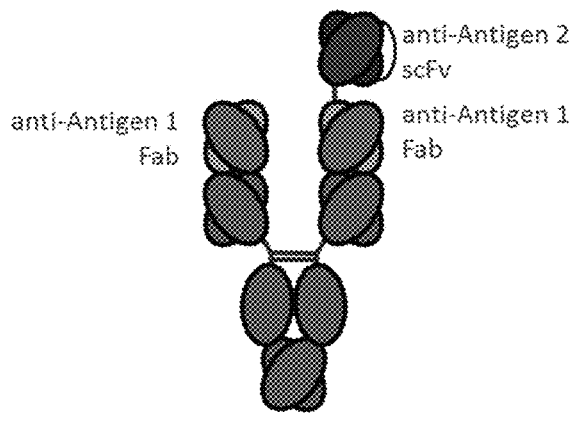
Figure 1F:
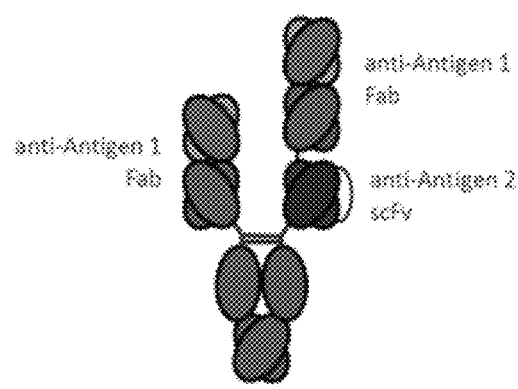

One heterodimeric scaffold that finds particular use in the subject bispecific FAP antibodies (e.g., FAP×CD3 bispecific antibody) is the 2+1 Fab2-scFv-Fc format (also referred to as "central-scFv format") shown in FIG. 1F. In this embodiment, the format relies on the use of an inserted scFv domain thus forming a third antigen binding domain, wherein the Fab portions of the two monomers each bind a FAP and the "extra" scFv domain binds CD3. The scFv domain is inserted between the Fc domain and the CH1-Fv region of one of the monomers, thus providing a third antigen binding domain. As described, for example, in Example 2 herein, FAP×CD3 bispecific antibodies having the 2+1 Fab2-scFv-Fc format are potent in inducing redirected T cell cytotoxicity in cellular environments that express low levels of FAP. Moreover, as shown in the examples, FAP×CD3 bispecific antibodies having the 2+1 Fab2-scFv-Fc format allow for the "fine tuning" of immune responses as such antibodies exhibit a wide variety of different properties, depending on the FAP and/or CD3 binding domains used. For example, such antibodies exhibit differences in selectivity for cells with different FAP expression, potencies for FAP expressing cells, ability to elicit coyote release, and sensitivity to soluble FAP. These FAP antibodies find use, for example, in the treatment of FAP associated cancers.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (VH1-CH1-[optional linker]-VH2-scFv linker-VH2-[optional linker]-CH2-CH3, or the opposite orientation for the scFv, VH1-CH1-[optional linker]-VL2-scFv linker-VH2-[optional linker]-CH2-CH3). In some embodiments, the optional linker is a hinge or fragment thereof. The other monomer is a standard Fab side. (i.e., VH1-CH1-hinge-CH2-CH3). This embodiment further utilizes a common light chain comprising a variable light domain and a constant light domain, which associates with the heavy chains to form two identical Fabs that bind FAP. As for many of the embodiments herein, these constructs include skew variants, pI variants, ablation variants, additional Fc variants, etc. as desired and described herein.

In one embodiment, the 2+1 Fab2-scFv-Fc format antibody includes an scFv with the VH and VL of a CD3 binding domain sequence depicted in FIG. 12 or the Sequence Listing. In one embodiment, the 2+1 Fab2-scFv-Fc format antibody includes two Fabs having the VH and VL of a FAP binding domain as shown in FIGS. 13-15 and the Sequence Listing. Particularly useful FAP and CD3 sequence combinations for use with the 2+1 Fab2-scFv-Fc format antibody include [αFAP]_H0.26_L0×H1.32_L1.47, [αFAP] H0.26_L0.11×H1.32_L1.47, [αFAP]_H0.26_L0.19× H1.32_L1.47, 1A7B5 H1_L1×H1.32_L1.47, 1E5A5 H1_L1×H1.32_L1.47, 1E5A5 (common light chain) H1_L1×H1.32_L1.47, and 1F4B5 H1_L1×H1.32_L1.47 and those disclosed FIGS. 43E and F.

In addition, the Fc domains of the 2+1 Fab2-scFv-Fc antibody are variant Fc domains that include skew variants (e.g., a set of amino acid substitutions as shown in FIGS. 3 and 8, with particularly useful skew variants including S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/ Y349C:T366W/S354C)), optionally ablation variants (including those shown in FIG. 5), optionally charged scFv linkers (including those shown in FIG. 7) and pI variants on one or both of the variant Fc domains (including those shown in FIG. 4).

In some embodiments, the 2+1 Fab2-scFv-Fc format antibody includes skew variants, pI variants, and ablation variants. Accordingly, some embodiments include 2+1 Fab2-scFv-Fc formats that comprise: a) a first monomer (the Fab-scFv-Fc side) that comprises the skew variants S364K/ E357Q, the ablation variants E233P/L234V/L235A/ G236del/S267K, and a variable heavy domain that, with the variable light domain of the light chain, makes up an Fv that binds to FAP as outlined herein, and an scFv domain that binds to CD3; b) a second monomer (the Fab-Fc side) that comprises the skew variants L368D/K370S, the pI variants N208D/Q295E/N384D/Q418E/N421D, the ablation variants E233P/L234V/L235A/G236del/S267K, and a variable heavy domain that, with variable light domain of the light chain, makes up an Fv that binds to FAP as outlined herein; and c) a light chain comprising the variable light domain and a constant light domain.

In some embodiments, the 2+1 Fab2-scFv-Fc format antibody includes skew variants, pI variants, ablation variants and FcRn variants. Accordingly, some embodiments include 2+1 Fab2-scFv-Fc formats that comprise: a) a first monomer (the Fab-scFv-Fc side) that comprises the skew variants S364K/E357Q, the ablation variants E233P/L234V/ L235A/G236del/S267K, the FcRn variants M428L/N434S and a variable heavy domain that, with the variable light domain of the light chain, makes up an Fv that binds to FAP as outlined herein, and an scFv domain that binds to CD3; b) a second monomer (the Fab-Fc side) that comprises the skew variants L368D/K370S, the pI variants N208D/ Q295E/N384D/Q418E/N421D, the ablation variants E233P/ L234V/L235A/G236del/S267K, the FcRn variants M428L/ N434S and a variable heavy domain that, with variable light domain of the light chain, makes up an Fv that binds to FAP as outlined herein; and c) a light chain comprising a variable light domain and a constant light domain.

CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 12 and 13. FAP binding domain sequences that are of particular use in these embodiments include, [αFAP]_H0.26_L0, [αFAP] H0.26_L0.11, [αFAP] H0.26_L0.19, 1A7B5 H1_L1, 1E5A5 H1_L1, 1E5A5 (common light chain) H1_L1, and 1F4B5 H1_L1, as well as those depicted in FIGS. 13-15.

In one embodiment, the FAPxCD3 2+1 Fab2-scFv-Fc antibody includes an anti-CD3 scFv with the VH and VL of anti-CD3 H1.30_L1.47 (see, e.g., FIG. 12) and two Fabs, each Fab having the VH and VL of a FAP binding domain, wherein the FAP binding domain is, [αFAP] H0.26_L0, [αFAP]_H0.26_L0.11, [αFAP] H0.26_L0.19, 1A7B5 H1_L1, 1E5A5 H1_L1, 1E5A5 (common light chain) H1_L1, or 1F4B5 H1_L1 (see, e.g., FIG. 14).

In another embodiment, the FAPxCD3 2+1 Fab2-scFv-Fc antibody includes an anti-CD3 scFv with the VH and VL of anti-CD3 H1.32_L1.47 (see, e.g., FIG. 12) and two Fabs, each Fab having the VH and VL of a FAP binding domain, wherein the FAP binding domain is, [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, or 1F4B5 H1_L1 (see, e.g., FIG. 14).

In one embodiment, the FAPxCD3 2+1 Fab2-scFv-Fc antibody includes an anti-CD3 scFv with the VH and VL of anti-CD3 H1.89_L1.47 (see, e.g., FIG. 12) and two Fabs, each Fab having the VH and VL of a FAP binding domain, wherein the FAP binding domain is, [αFAP]_H0.26_L0, [αFAP]_H0.26_L0.11, [αFAP] H0.26_L0.19, 1A7B5 H1_L1, 1E5A5 H1_L1, 1E5A5 (common light chain) H1_L1, or 1F4B5 H1_L1 (see, e.g., FIG. 14).

In another embodiment, the FAPxCD3 2+1 Fab2-scFv-Fc antibody includes an anti-CD3 scFv with the VH and VL of anti-CD3 H1.90_L1.47 (see, e.g., FIG. 12) and two Fabs, each Fab having the VH and VL of a FAP binding domain, wherein the FAP binding domain is, [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, or 1F4B5 H1_L1 (see, e.g., FIG. 14).

In yet another embodiment, the FAPxCD3 2+1 Fab2-scFv-Fc antibody includes an anti-CD3 scFv with the VH and VL of anti-CD3 H1.33_L1.47 (see, e.g., FIG. 12) and two Fabs, each Fab having the VH and VL of a FAP binding domain, wherein the FAP binding domain is, [αFAP]_H0.26_L0, [αFAP] H0.26_L0.11, [αFAP]_H0.26_L0.19, 1A7B5 H1_L1, 1E5A5 H1_L1, 1E5A5 (common light chain) H1_L1, or 1F4B5 H1_L1 (see, e.g., FIG. 14).

In one embodiment, the FAPxCD3 2+1 Fab2-scFv-Fc antibody includes an anti-CD3 scFv with the VH and VL of anti-CD3 H1.31_L1.47 (see, e.g., FIG. 12) and two Fabs, each Fab having the VH and VL of a FAP binding domain, wherein the FAP binding domain is, [αFAP] H0.26_L0, [αFAP]_H0.26_L0.11, [αFAP] H0.26_L0.19, 1A7B5 H1_L1, 1E5A5 H1_L1, 1E5A5 (common light chain) H1_L1, or 1F4B5 H1_L1 (see, e.g., FIG. 14).

In an exemplary embodiment, the FAP 2+1 Fab2-scFv-Fc antibody includes: a) a first monomer that includes a VH1-CH1-linker 1-scFv-linker 2-CH2-CH3, where CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In an exemplary embodiment, the FAP 2+1 Fab2-scFv-Fc antibody includes: a) a first monomer that includes a VH1-CH1-linker 1-scFv-linker 2-CH2-CH3, where CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain, respectively, of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.30_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.32_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.89_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.90_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.33_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.31_L1.47 and CH2-CH3 is a first variant Fc domain; b) a second monomer that includes a VH1-CH1-hinge-CH2-CH3, wherein CH2-CH3 is a second variant Fc domain; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14).

In one embodiment, the FAP 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain, respectively, of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In certain embodiments, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.30_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In one embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.32_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In some embodiments, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.89_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In certain embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.90_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In one embodiment, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.33_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In some embodiments, the FAP 2+1 Fab2-scFv-Fc antibody includes: a) a first monomer that includes a VH1-CH1-linker 1-scFv-linker 2-CH2-CH3, where scFv is an anti-CD3 scFv having the VH and VL of anti-CD3 H1.31_L1.47 and CH2-CH3 is a first variant Fc domain that includes heterodimerization variants S364K/E357Q; b) a second monomer that includes a VH1-CH1-hinge-CH2-CH3, wherein CH2-CH3 is a second variant Fc domain that includes heterodimerization variants L368D/K370S; and c) a light chain that includes a VL1, wherein VH1 and VL1 are the variable heavy domain and variable light domain of one of the following FAP binding domains: [αFAP]_H0.26_L0, [αFAP]H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14). In some embodiments, the first and second variant Fc domains further include FcKO variants E233P/L234V/L235A/G236del/S267K. In one embodiment, the hinge-CH2-CH3 of the second monomer further includes pI variants N208D/Q295E/N384D/Q418E/N421D. In an exemplary embodiment, the first and second variant Fc domains further include FcKO variants E233P/L234V/L235A/G236del/S267K and the hinge-CH2-CH3 of the second monomer further includes pI variants N208D/Q295E/N384D/Q418E/N421D.

In some embodiments, the 2+1 Fab2-scFv-Fc format antibody utilize the 2+1 Fab2-scFv-Fc backbone sequences of any one of the utilize the 2+1 Fab2-scFv-Fc backbone sequences in FIGS. 10 and 63 (optionally including M428L/N434S).

In certain embodiments, the FAP×CD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.30_L1.47-no Xtend" (SEQ ID NO: 401), CH2-CH3 of the second monomer has the sequence of "Chain 1" of "2+1-H1.30_L1.47-no Xtend" (SEQ ID NO: 400), and CL has the second of "Chain 3" of "2+1-H1.30_L1.47-no Xtend" (SEQ ID NO: 402) (See FIG. 63).

In some embodiments, the FAP×CD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.32_L1.47-no Xtend" (SEQ ID NO: 404), CH2-CH3 of the second monomer has the sequence of "Chain 1" of "2+1-H1.32_L1.47-no Xtend" (SEQ ID NO: 403), and CL has the second of "Chain 3" of "2+1-H1.32_L1.47-no Xtend" (SEQ ID NO: 405) (See FIG. 63).

In certain embodiments, the FAP×CD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.89_L1.47-no Xtend" (SEQ ID NO: 407), CH2-CH3 of the second monomer has the sequence of "Chain 1" of "2+1-H1.89_L1.47-no Xtend" (SEQ ID NO: 406), and CL has the second of "Chain 3" of "2+1-H1.89_L1.47-no Xtend" (SEQ ID NO: 408) (See FIG. 63).

In one embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.90_L1.47-no Xtend" (SEQ ID NO: 410), CH2-CH3 of the second monomer has the sequence of "Chain 1" of "2+1-H1.90_L1.47-no Xtend" (SEQ ID NO: 409), and CL has the second of "Chain 3" of "2+1-H1.90_L1.47-no Xtend" (SEQ ID NO: 411) (See FIG. 63).

In certain embodiments, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP] H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.33_L1.47-no Xtend" (SEQ ID NO: 413), CH2-CH3 of the second monomer has the sequence of "Chain 1" of "2+1-H1.33_L1.47-no Xtend" (SEQ ID NO: 412), and CL has the second of "Chain 3" of "2+1-H1.33_L1.47-no Xtend" (SEQ ID NO: 414) (See FIG. 63).

In some embodiments, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.31_L1.47-no Xtend" (SEQ ID NO: 416), CH2-CH3 of the second monomer has the sequence of "Chain 1" of "2+1-H1.31_L1.47-no Xtend" (SEQ ID NO: 415), and CL has the second of "Chain 3" of "2+1-H1.31_L1.47-no Xtend" (SEQ ID NO: 417) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.30_L1.47-with Xtend" (SEQ ID NO: 437), CH2-CH3 of the second monomer has the sequence of "Chain 1" of "2+1-H1.30_L1.47-with Xtend" (SEQ ID NO: 436), and CL has the second of "Chain 3" of "2+1-H1.30_L1.47-with Xtend" (SEQ ID NO: 438) (See FIG. 63).

In an exemplary embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.32_L1.47-with Xtend" (SEQ ID NO: 440), CH2-CH3 of the second monomer has the sequence of "Chain 1" of "2+1-H1.32_L1.47-with Xtend" (SEQ ID NO: 439), and CL has the second of "Chain 3" of "2+1-H1.32_L1.47-with Xtend" (SEQ ID NO: 441) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.89_L1.47-with Xtend" (SEQ ID NO: 443), CH2-CH3 of the second monomer has the sequence of "Chain 1" of "2+1-H1.89_L1.47-with Xtend" (SEQ ID NO: 442), and CL has the second of "Chain 3" of "2+1-H1.89_L1.47-with Xtend" (SEQ ID NO: 444) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP] H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.90_L1.47-with Xtend" (SEQ ID NO: 446), CH2-CH3 of the second monomer has the sequence of "Chain 1" of "2+1-H1.90_L1.47-with Xtend" (SEQ ID NO: 445), and CL has the second of "Chain 3" of "2+1-H1.90_L1.47-with Xtend" (SEQ ID NO: 447) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.33_L1.47-with Xtend" (SEQ ID NO: 449), CH2-CH3 of the second monomer has the sequence of "Chain 1" of "2+1-H1.33_L1.47-with Xtend" (SEQ ID NO: 448), and CL has the second of "Chain 3" of "2+1-H1.33_L1.47-with Xtend" (SEQ ID NO: 450) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-H1.31_L1.47-with Xtend" (SEQ ID NO: 452), CH2-CH3 of the second monomer has the sequence of "Chain 1" of "2+1-H1.31_L1.47-with Xtend" (SEQ ID NO: 451), and CL has the second of "Chain 3" of "2+1-H1.31_L1.47-with Xtend" (SEQ ID NO: 453) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.30-no Xtend" (SEQ ID NO: 419), CH2-CH3 of the second monomer has the sequence of "Chain 1" of "2+1-L1.47_H1.30-no Xtend" (SEQ ID NO: 418), and CL has the second of "Chain 3" of "2+1-L1.47_H1.30-no Xtend" (SEQ ID NO: 420) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.32-no Xtend" (SEQ ID NO: 422), CH2-CH3 of the second monomer has the sequence of "Chain 1" of "2+1-L1.47_H1.32-no Xtend" (SEQ ID NO: 421), and CL has the second of "Chain 3" of "2+1-L1.47_H1.32-no Xtend" (SEQ ID NO: 423) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.89-no Xtend" (SEQ ID NO: 425), CH2-CH3 of the second monomer has the sequence of "Chain 1" of "2+1-L1.47_H1.89-no Xtend" (SEQ ID NO: 424), and CL has the second of "Chain 3" of "2+1-L1.47_H1.89-no Xtend" (SEQ ID NO: 426) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.90-no Xtend" (SEQ ID NO: 428), CH2-CH3 of the second monomer has the sequence of "Chain 1" of "2+1-L1.47_H1.90-no Xtend" (SEQ ID NO: 427), and CL has the second of "Chain 3" of "2+1-L1.47_H1.90-no Xtend" (SEQ ID NO: 429) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.33-no Xtend" (SEQ ID NO: 431), CH2-CH3 of the second monomer has the sequence of "Chain 1" of "2+1-L1.47_H1.33-no Xtend" (SEQ ID NO: 430), and CL has the second of "Chain 3" of "2+1-L1.47_H1.33-no Xtend" (SEQ ID NO: 432) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.31-no Xtend" (SEQ ID NO: 434), CH2-CH3 of the second monomer has the sequence of "Chain 1" of "2+1-L1.47_H1.31-no Xtend" (SEQ ID NO: 433), and CL has the second of "Chain 3" of "2+1-L1.47_H1.31-no Xtend" (SEQ ID NO: 435) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.30-with Xtend" (SEQ ID NO: 455), CH2-CH3 of the second monomer has the sequence of "Chain 1" of "2+1-L1.47_H1.30-with Xtend" (SEQ ID NO: 454), and CL has the second of "Chain 3" of "2+1-L1.47_H1.30-with Xtend" (SEQ ID NO: 456) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.32-with Xtend" (SEQ ID NO: 458), CH2-CH3 of the second monomer has the sequence of "Chain 1" of "2+1-L1.47_H1.32-with Xtend" (SEQ ID NO: 457), and CL has the second of "Chain 3" of "2+1-L1.47_H1.32-with Xtend" (SEQ ID NO: 459) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.89-with Xtend" (SEQ ID NO: 461), CH2-CH3 of the second monomer has the sequence of "Chain 1" of "2+1-L1.47_H1.89-with Xtend" (SEQ ID NO: 460), and CL has the second of "Chain 3" of "2+1-L1.47_H1.89-with Xtend" (SEQ ID NO: 462) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.90-with Xtend" (SEQ ID NO: 464), CH2-CH3 of the second monomer has the sequence of "Chain 1" of "2+1-L1.47_H1.90-with Xtend" (SEQ ID NO: 463), and CL has the second of "Chain 3" of "2+1-L1.47_H1.90-with Xtend" (SEQ ID NO: 465) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.33-with Xtend" (SEQ ID NO: 467), CH2-CH3 of the second monomer has the sequence of "Chain 1" of "2+1-L1.47_H1.33-with Xtend" (SEQ ID NO: 466), and CL has the second of "Chain 3" of "2+1-L1.47_H1.33-with Xtend" (SEQ ID NO: 468) (See FIG. 63).

In certain embodiment, the FAPxCD3 2+1 Fab2-scFv-Fc antibody includes: a) a first monomer that includes a VH1-CH1-linker 1-scFv-linker 2-CH2-CH3, where scFv is an anti-CD3 scFv and CH2-CH3 is a first variant Fc domain; b) a second monomer that includes a VH1-CH1-hinge-CH2-CH3, wherein CH2-CH3 is a second variant Fc domain; and c) a light chain that includes a VL1 and CL, wherein VH1 and VL1 are the variable heavy domain and variable light domain of one of the following FAP binding domains: [αFAP]_H0.26_L0, [αFAP]_H0.26_L0.11, [αFAP]_H0.26_L0.19, 1A7B5 H1_L1, 1E5A5 H1_L1, 1E5A5 (common light chain) H1_L1, and 1F4B5 H1_L1 (see, e.g., FIG. 14), wherein scFv-linker 2-CH2-CH3 of the first monomer has the sequence of "Chain 2" of "2+1-L1.47_H1.31-with Xtend" (SEQ ID NO: 470), CH2-CH3 of the second monomer has the sequence of "Chain 1" of "2+1-L1.47_H1.31-with Xtend" (SEQ ID NO: 469), and CL has the second of "Chain 3" of "2+1-L1.47_H1.31-with Xtend" (SEQ ID NO: 471) (See FIG. 63).

Exemplary subject FAP×CD3 2+1 Fab2-scFv-Fc format antibodies are depicted in FIGS. 21, 51, 62 and 64-70. Exemplary FAP×CD3 subject 2+1 Fab2-scFv-Fc antibodies include XENP25393, XENP29140, XENP28115, XENP29141, XENP28116, XENP29142, XENP25193, XENP25194, XENP25195, XENP25967, XENC1145, XENC1123, XENC1079, and XENC1101.

2. 1+1 Fab-scFv-Fc format ("Bottle Opener")

One heterodimeric antibody format that finds particular use in subject FAP×CD3 bispecific antibody herein is the "1+1 Fab-scFv-Fc" or "bottle opener" format as shown in FIG. 1A. In this embodiment, one heavy chain monomers of the antibody contains a single chain Fv ("scFv", as defined below) and the other heavy chain monomer is a "regular" Fab format that includes a variable heavy chain and a variable light chain. This structure is sometimes referred to herein as the "bottle-opener" format, due to a rough visual similarity to a bottle-opener. The two heavy chain monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below.

There are several distinct advantages to the present "1+1 Fab-scFv-Fc" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g., heavy 1 pairing with light 2, etc.).

Many of the embodiments outlined herein rely in general on the 1+1 Fab-scFv-Fc format antibody that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker. The domain linker can be either charged or uncharged and exogenous or endogenous (e.g., all or part of the native hinge domain). The second monomer of the 1+1 Fab-scFv-Fc format is a heavy chain, and the composition further comprises a light chain.

In general, in many preferred embodiments, the scFv is the domain that binds to the CD3, and the Fab forms a FAP binding domain. An exemplary anti-FAP×anti-CD3 bispecific antibody in the 1+1 Fab-scFv-Fc format is depicted in FIG. 16A.

In addition, the Fc domains of the 1+1 Fab-scFv-Fc format generally comprise heterodimerization skew variants (e.g., a set of amino acid substitutions as shown in FIGS. 3 and 8. Particularly useful heterodimerization skew variants include S364K/E357Q:L368D/K370S; L368D/K370S: S364K; L368E/K370S:S364K; T411T/E360E/Q362E: D401K; L368D/K370S:S364K/E357L; K370S:S364K/ E357Q; T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4). In exemplary embodiments, the 1+1 Fab-scFv-Fc format antibody includes In certain embodiments, the 1+1 Fab-scFv-Fc scaffold format includes a first monomer that includes a scFv-hinge-CH2-CH3 monomer, a second monomer that includes a first variable heavy domain-CH1-hinge-CH2-CH3 monomer and a third monomer that includes a first variable light domain. In some embodiments, the CH2-CH3 of the first monomer is a first variant Fc domain and the CH2-CH3 of the second monomer is a second variant Fc domain. In some embodiments, the scFv includes a scFv variable heavy domain and a scFv variable light domain that form a CD3 binding moiety. In certain embodiments, the scFv variable heavy domain and scFv variable light domain are covalently attached using an scFv linker (charged, in many but not all instances). In some embodiments, the first variable heavy domain and first variable light domain form a FAP binding domain.

In some embodiments, the 1+1 Fab-scFv-Fc format includes skew variants, pI variants, and ablation variants. Accordingly, some embodiments include 1+1 Fab-scFv-Fc formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, and an scFv that binds to CD3 as outlined herein; b) a second monomer (the "Fab monomer") that comprises the skew variants L368D/ K370S, the pI variants N208D/Q295E/N384D/Q418E/ N421D, the ablation variants E233P/L234V/L235A/ G236del/S267K, and a variable heavy domain; and c) a light chain that includes a variable light domain. The variable heavy domain and variable light domain make up a FAP binding moiety.

Exemplary variable heavy and light domains of the scFv that binds to CD3 are included in FIG. 12. Exemplary variable heavy and light domains of the Fv that binds to FAP are included in FIGS. 13-15. In an exemplary embodiment, the FAP binding domain of the 1+1 Fab-scFv-Fc FAP×CD3 bispecific antibody includes the VH and VL of one of the following FAP binding domains: [αFAP]_H0.26_L0, [αFAP]_H0.26_L0.11, [αFAP]H0.26_L0.19, 1A7B5 H1_L1, 1E5A5 H1_L1, 1E5A5 (common light chain) H1_L1, and 1F4B5 H1_L1 (see, e.g., FIG. 14) (see FIG. 14). In one embodiment, the CD3 binding domain of the 1+1 Fab-scFv-Fc FAP×CD3 bispecific antibody includes the VH and VL of one of the following CD3 binding domains: H1.30_L1.47 (i.e., "CD3 high"), anti-CD3 H1.32_L1.47 (i.e., CD3 high-intermediate"), anti-CD3 H1.89_L1.47, anti-CD3 H1.90_L1.47, anti-CD3 H1.33_L1.47 and anti-CD3 H1.31_L1.47. Particularly useful FAP and CD3 combinations for use in the 1-+1 Fab-scFv-Fc FAP×CD3 bispecific antibody are disclosed in FIGS. 43 C and D and include 1E5A5 H1_L1×CD3 H1.30_L1.47; FAP 1A7B5 H1_L1× CD3 H1.30_L1.47; FAP 1E5A5 H1_L1×CD3 H1.30_L1.47; FAP 1F4B5 H1_L1×CD3 H1.30_L1.47; FAP 1F12B5 H1_L1×CD3 H1.30_L1.47; FAP 1F10B5 H1_L1×CD3 H1.30_L1.47; FAP 1F12B5 H1_L1×CD3 H1.32_L1.47; FAP 1F4B5 H1_L1×CD3 H1.32_L1.47; FAP 1F10B5 H1_L1×CD3 H1.32_L1.47; FAP 1A7B5 H1_L1×CD3 H1.32_L1.47; [αFAP]_H0.26_L0×CD3 H1.30_L1.47; [αFAP]_H0.26_L0×CD3 H1.32_L1.47; [αFAP]_ H0.26_L0.11×CD3 H1.30_L1.47; [αFAP]_H0.26_L0.11× CD3 H1.32_L1.47; [αFAP]_H0.26_L0.19×CD3 H1.30_L1.47; and [αFAP]_H0.26_L0.19×CD3 H1.32_L1.47.

In some embodiments, the 1+1 Fab-scFv-Fc format includes skew variants, pI variants, ablation variants and FcRn variants. Accordingly, some embodiments include 1+1 Fab-scFv-Fc formats that comprise: a) a first monomer (the "scFv monomer") that comprises a charged scFv linker (with the +H sequence of FIG. 7 being preferred in some embodiments), the skew variants S364K/E357Q, the ablation variants E233P/L234V/L235A/G236del/S267K, the FcRn variants M428L/N434S and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain. The variable heavy domain and variable light domain make up a FAP binding domain.

FIG. 9 shows some exemplary 1+1 Fab-scFv-Fc "backbone" sequences that are missing the Fv sequences that can be used in the present invention. In some embodiments, any of the vh and vl sequences depicted herein (including all vh and vl sequences depicted in the Figures and Sequence Listings, including those directed to FAP) can be added to the 1+1 Fab-scFv-Fc backbone formats of FIG. 9 as the "Fab side", using any of the anti-CD3 scFv sequences shown in the Figures and Sequence Listings.

For 1+1 Fab-scFv-Fc backbone 1 from FIG. 9, (optionally including the 428L/434S variants), CD3 binding domain sequences finding particular use in these embodiments include, but are not limited to, CD3 binding domain anti-CD3 H1.30_L1.47 (i.e., "CD3 high"), anti-CD3 H1.32_L1.47 (i.e., CD3 high-intermediate"), anti-CD3 H1.89_L1.47, anti-CD3 H1.90_L1.47, anti-CD3 H1.33_L1.47 and anti-CD3 H1.31_L1.47, as well as those depicted in FIG. 12, attached as the scFv side of the backbones shown in FIG. 9.

For 1+1 Fab-scFv-Fc backbone 1 from FIG. 9, (optionally including the 428L/434S variants), FAP binding domain sequences that are of particular use in these embodiments include, but are not limited to, 1A4A5 H1_L1; 1C3A5 H1_L1; 1E5A5 H1_L1; 1E5A5 (common light chain) H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15, attached as the Fab side of the backbones shown in FIG. 9.

Particularly useful FAP and CD3 sequence combinations for use with 1+1 Fab-scFv-Fc backbone 1 from FIG. 9, (optionally including the 428L/434S variants), are disclosed in FIGS. 43 C and D.

In some exemplary embodiment, the 1+1 Fab-scFv-Fc antibody includes 1+1 Fab-scFv-Fc "backbone" 1 from FIG. 9, the FAP and CD3 combinations are selected from the group consisting of FAP 1E5A5 H1_L1×CD3 H1.30_L1.47; FAP 1A7B5 H1_L1×CD3 H1.30_L1.47; FAP 1E5A5 H1_L1×CD3 H1.30_L1.47; FAP 1F4B5 H1_L1×CD3 H1.30_L1.47; FAP 1F12B5 H1_L1×CD3 H1.30_L1.47; FAP 1F10B5 H1_L1×CD3 H1.30_L1.47; FAP 1F12B5 H1_L1×CD3 H1.32_L1.47; FAP 1F4B5 H1_L1×CD3 H1.32_L1.47; FAP 1F10B5 H1_L1×CD3 H1.32_L1.47; FAP 1A7B5 H1_L1×CD3 H1.32_L1.47; [αFAP]_H0.26_L0×CD3 H1.30_L1.47; [αFAP]_H0.26_L0×CD3 H1.32_L1.47; [αFAP]_H0.26_L0.11×CD3 H1.30_L1.47; [αFAP]_H0.26_L0.11×CD3 H1.32_L1.47; [αFAP]_H0.26_L0.19×CD3 H1.30_L1.47; and [αFAP]_H0.26_L0.19×CD3 H1.32_L1.47. Other particularly useful FAP and CD3 sequence combinations for use with the 1+1 Fab-scFv-Fc format are disclosed in FIGS. 43C and D.

3. mAb-Fv format

One heterodimeric scaffold that finds particular use in the present invention is the mAb-Fv format shown in FIG. 1G. In this embodiment, the format relies on the use of a C-terminal attachment of an "extra" variable heavy domain to one monomer and the C-terminal attachment of an "extra" variable light domain to the other monomer, thus forming a third antigen binding domain (i.e. an "extra" Fv domain), wherein the Fab portions of the two monomers bind a FAP and the "extra" third antigen binding domain binds CD3.

In this embodiment, the first monomer comprises a first heavy chain, comprising a first variable heavy domain and a first constant heavy domain comprising a first Fc domain, with a second variable heavy domain covalently attached to the C-terminus of the first Fc domain using a domain linker (vh1-CH1-hinge-CH2-CH3-[optional linker]-vh2).

The second monomer comprises a first variable heavy domain, a second constant heavy domain comprising a second Fc domain, and a second variable heavy domain covalently attached to the C-terminus of the second Fc domain using a domain linker (vh1-CH1-hinge-CH2-CH3-[optional linker]-vl2. This embodiment further utilizes a common light chain comprising a first variable light domain and a constant light domain. The common light chain associates with the heavy chains to form two identical Fabs, including two identical Fvs that bind FAP. The two C-terminally attached variable domains (vh2 and vl2) make up an "extra" third Fv that binds CD3 (as it is less preferred to have bivalent CD3 binding). As for many of the embodiments herein, these constructs include skew variants, pI variants, ablation variants, additional Fc variants, etc. as desired and described herein.

The present invention provides mAb-Fv formats where the CD3 binding domain sequences are as shown in FIGS. 14 and 15 and the Sequence Listing. The present invention provides mAb-Fv formats wherein the FAP binding domain sequences are as shown in FIGS. 11-13 and the Sequence Listing. Particularly useful FAP and CD3 sequence combinations for use with the mAb-Fv format include but are not limited to: FAP 1E5A5 H1_L1×CD3 H1.30_L1.47; FAP 1A7B5 H1_L1×CD3 H1.30_L1.47; FAP 1E5A5 H1_L1×CD3 H1.30_L1.47; FAP 1F4B5 H1_L1×CD3 H1.30_L1.47; FAP 1F12B5 H1_L1×CD3 H1.30_L1.47; FAP 1F10B5 H1_L1×CD3 H1.30_L1.47; FAP 1F12B5 H1_L1×CD3 H1.32_L1.47; FAP 1F4B5 H1_L1×CD3 H1.32_L1.47; FAP 1F10B5 H1_L1×CD3 H1.32_L1.47; FAP 1A7B5 H1_L1×CD3 H1.32_L1.47. Other particularly useful FAP and CD3 sequence combinations for use with the 1+1 Fab-scFv-Fc format are disclosed in FIGS. 43A and B.

In addition, the Fc domains of the mAb-Fv format generally comprise skew variants (e.g., a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to FAP, and a second variable heavy domain; b) a second monomer that comprises the skew variants L368D/K370S, the pI variants N208D/Q295E/

N384D/Q418E/N421D, the ablation variants E233P/L234V/ L235A/G236del/S267K, and a first variable heavy domain that, with the first variable light domain, makes up the Fv that binds to FAP as outlined herein, and a second variable light chain, that together with the second variable heavy domain forms an Fv (ABD) that binds to CD3; and c) a light chain comprising a first variable light domain and a constant light domain.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/ L235A/G236del/S267K, the FcRn variants M428L/N434S and a first variable heavy domain that, with the first variable light domain of the light chain, makes up an Fv that binds to FAP, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to FAP as outlined herein, and a second variable light chain, that together with the second variable heavy domain of the first monomer forms an Fv (ABD) that binds CD3; and c) a light chain comprising a first variable light domain and a constant light domain.

For mAb-Fv sequences that are similar to the mAb-Fv backbone 1 from FIG. 10, (optionally including the M428L/ 434S variants), CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

For mAb-Fv sequences that are similar to the mAb-Fv backbone 1 from FIG. 10, (optionally including the M428L/ 434S variants), FAP binding domain sequences that are of particular use in these embodiments include, but are not limited to, 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1.

Particularly useful FAP and CD3 sequence combinations for use with mAb-Fv sequences that are similar to the mAb-Fv backbone 1 from FIG. 11, (optionally including the 428L/434S variants), include, but are not limited to FAP 1E5A5 H1_L1×CD3 H1.30_L1.47; FAP 1A7B5 H1_L1× CD3 H1.30_L1.47; FAP 1E5A5 H1_L1×CD3 H1.30_L1.47; FAP 1F4B5 H1_L1×CD3 H1.30_L1.47; FAP 1F12B5 H1_L1×CD3 H1.30_L1.47; FAP 1F10B5 H1_L1×CD3 H1.30_L1.47; FAP 1F12B5 H1_L1×CD3 H1.32_L1.47; FAP 1F4B5 H1_L1×CD3 H1.32_L1.47; FAP 1F10B5 H1_L1×CD3 H1.32_L1.47; FAP 1A7B5 H1_L1×CD3 H1.32_L1.47. Other particularly useful FAP and CD3 sequence combinations for use with the 1+1 Fab-scFv-Fc format are disclosed in FIGS. 43A and B.

4. mAb-scFv Format

One heterodimeric scaffold that finds particular use in the present invention is the mAb-scFv format shown in FIG. 1H. In this embodiment, the format relies on the use of a C-terminal attachment of an scFv to one of the monomers, thus forming a third antigen binding domain, wherein the Fab portions of the two monomers each bind a FAP and the "extra" scFv domain binds CD3.

In this embodiment, the first monomer comprises a first heavy chain (comprising a variable heavy domain and a constant domain), with a C-terminally covalently attached scFv comprising a scFv variable light domain, an scFv linker and a scFv variable heavy domain in either orientation (vh1-CH1-hinge-CH2-CH3-[optional linker]-vh2-scFv linker-vl2 or vh1-CH1-hinge-CH2-CH3-[optional linker]- vl2-scFv linker-vh2). The second monomer comprises a second heavy chain (vh1-CH1-hinge-CH2-CH3). This embodiment further utilizes a common light chain comprising a variable light domain and a constant light domain, which associates with the heavy chains to form two identical Fabs that bind FAP. As for many of the embodiments herein, these constructs include skew variants, pI variants, ablation variants, additional Fc variants, etc. as desired and described herein.

The present invention provides mAb-scFv formats where the CD3 binding domain sequences are as shown in FIG. 12 and the Sequence Listing. The present invention provides mAb-scFv formats wherein the FAP binding domain sequences are as shown in FIGS. 13-15 and the Sequence Listing. Particularly useful FAP and CD3 sequence combinations for use with the mAb-scFv format are disclosed in FIGS. 43A and B.

In addition, the Fc domains of the mAb-scFv format generally comprise skew variants (e.g., a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-scFv format includes skew variants, pI variants, and ablation variants. Accordingly, some embodiments include 1+1 Fab-scFv-Fc formats that comprise: a) a first monomer that comprises the skew variants S364K/E357Q, the ablation variants E233P/L234V/ L235A/G236del/S267K, and a first variable heavy domain that, with the first variable light domain, makes up an Fv that binds to FAP as outlined herein, and a scFv domain that binds to CD3; b) a second monomer that comprises the skew variants L368D/K370S, the pI variants N208D/Q295E/ N384D/Q418E/N421D, the ablation variants E233P/L234V/ L235A/G236del/S267K, and a first variable heavy domain that, with the first variable light domain, makes up an Fv that binds to FAP as outlined herein; and c) a light chain comprising a first variable light domain and a constant light domain.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q, the ablation variants E233P/ L234V/L235A/G236del/S267K, the FcRn variants M428L/ N434S and a first variable heavy domain that, with the first variable light domain, makes up an Fv that binds to FAP as outlined herein, and a scFv domain that binds to CD3; b) a second monomer that comprises the skew variants L368D/ K370S, the pI variants N208D/Q295E/N384D/Q418E/ N421D, the ablation variants E233P/L234V/L235A/ G236del/S267K, the FcRn variants M428L/N434S and a first variable heavy domain that, with the first variable light domain, makes up an Fv that binds to FAP as outlined herein; and c) a light chain comprising a first variable light domain and a constant light domain.

In mAb-scFv backbone 1 (optionally including M428L/N434S) from FIG. 11, (optionally including the 428L/434S variants) CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

In mAb-scFv backbone 1 (optionally including M428L/N434S) from FIG. 10, (optionally including the 428L/434S variants), FAP binding domain sequences that are of particular use in these embodiments include, but are not limited to, but are not limited to FAP 1E5A5 H1_L1×CD3 H1.30_L1.47; FAP 1A7B5 H1_L1×CD3 H1.30_L1.47; FAP 1E5A5 H1_L1×CD3 H1.30_L1.47; FAP 1F4B5 H1_L1× CD3 H1.30_L1.47; FAP 1F12B5 H1_L1×CD3 H1.30_L1.47; FAP 1F10B5 H1_L1×CD3 H1.30_L1.47; FAP 1F12B5 H1_L1×CD3 H1.32_L1.47; FAP 1F4B5 H1_L1×CD3 H1.32_L1.47; FAP 1F10B5 H1_L1×CD3 H1.32_L1.47; FAP 1A7B5 H1_L1×CD3 H1.32_L1.47. Other particularly useful FAP and CD3 sequence combinations for use with the 1+1 Fab-scFv-Fc format are disclosed in FIGS. 43A and B.

5. Central-Fv Format

One heterodimeric scaffold that finds particular use in the present invention is the central-Fv format shown in FIG. 1I. In this embodiment, the format relies on the use of an inserted Fv domain (i.e., the central Fv domain) thus forming an "extra" third antigen binding domain, wherein the Fab portions of the two monomers bind a FAP and the "extra" central Fv domain binds CD3. The "extra" central Fv domain is inserted between the Fc domain and the CH1-Fv region of the monomers, thus providing a third antigen binding domain (i.e., the "extra" central Fv domain), wherein each monomer contains a component of the "extra" central Fv domain (i.e., one monomer comprises the variable heavy domain and the other a variable light domain of the "extra" central Fv domain).

In this embodiment, one monomer comprises a first heavy chain comprising a first variable heavy domain, a CH1 domain, and Fc domain and an additional variable light domain. The additional variable light domain is covalently attached between the C-terminus of the CH1 domain of the heavy constant domain and the N-terminus of the first Fc domain using domain linkers (vh1-CH1-[optional linker]-vl2-hinge-CH2-CH3). The other monomer comprises a first heavy chain comprising a first variable heavy domain, a CH1 domain and Fc domain and an additional variable heavy domain (vh1-CH1-[optional linker]-vh2-hinge-CH2-CH3). The additional variable heavy domain is covalently attached between the C-terminus of the CH1 domain of the heavy constant domain and the N-terminus of the first Fc domain using domain linkers.

This embodiment utilizes a common light chain comprising a variable light domain and a constant light domain, that associates with the heavy chains to form two identical Fabs that each bind a FAP. The additional variable heavy domain and additional variable light domain (vh2 and vl2) form an "extra" central Fv that binds CD3. As for many of the embodiments herein, these constructs include skew variants, pI variants, ablation variants, additional Fc variants, etc. as desired and described herein.

The present invention provides central-Fv formats where the CD3 binding domain sequences are as shown in FIG. 12 and the Sequence Listing. The present invention provides central-Fv formats wherein the FAP binding domain sequences are as shown in FIGS. 13-15 and the Sequence Listing. Particularly useful FAP and CD3 sequence combinations for use with the central-Fv format are disclosed FIGS. 43 A and B.

In addition, the Fc domains of the one armed central-Fv format generally include skew variants (e.g., a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the central-Fv format includes skew variants, pI variants, and ablation variants. Accordingly, some embodiments include central-Fv formats that comprise: a) a first monomer that comprises the skew variants S364K/E357Q, the ablation variants E233P/L234V/L235A/G236del/S267K, a first variable heavy domain that, with the first variable light domain of the light chain, makes up an Fv that binds to FAP, and a second variable heavy domain that, with the second variable light domain of the second monomer makes up the "extra" central Fv that binds CD3; b) a second monomer that comprises the skew variants L368D/K370S, the pI variants N208D/Q295E/N384D/Q418E/N421D, the ablation variants E233P/L234V/L235A/G236del/S267K, a first variable heavy domain that, with the first variable light domain, makes up the Fv that binds to FAP, and a second variable light domain that, with the second variable heavy domain of the first monomer makes up the "extra" central Fv that binds CD3; and c) a light chain comprising a first variable light domain and a constant light domain.

In some embodiments, the central-Fv format includes skew variants, pI variants, ablation variants and FcRn variants. Accordingly, some embodiments include central-Fv formats that comprise: a) a first monomer that comprises the skew variants S364K/E357Q, the ablation variants E233P/L234V/L235A/G236del/S267K, the FcRn variants M428L/N434S, a first variable heavy domain that, with the first variable light domain of the light chain, makes up an Fv that binds to FAP, and a second variable heavy domain that, with the second variable light domain of the second monomer makes up the "extra" central Fv that binds CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S, a first variable heavy domain that, with the first variable light domain, makes up the Fv that binds to FAP, and a second variable light domain that, with the second variable heavy domain of the first monomer makes up the "extra" central Fv that binds CD3; and c) a light chain comprising a first variable light domain and a constant light domain.

For central-Fv formats, CD3 binding domain sequences finding particular use in these embodiments include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIGS. 14 and 15.

For central-Fv formats, FAP binding domain sequences that are of particular use in these embodiments include, but are not limited to: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

6. One Armed Central-scFv Format

One heterodimeric scaffold that finds particular use in the present invention is the one armed central-scFv format shown in FIG. 1C. In this embodiment, one monomer comprises just an Fc domain, while the other monomer includes a Fab domain (a first antigen binding domain), a scFv domain (a second antigen binding domain) and an Fc domain, where the scFv domain is inserted between the Fc domain and the Fc domain. In this format, the Fab portion binds one receptor target and the scFv binds another. In this format, either the Fab portion binds a FAP and the scFv binds CD3 or vice versa.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers, in either orientation, VH1-CH1-[optional domain linker]-VH2-scFv linker-VL2-[optional domain linker]-CH2-CH3 or VH1-CH1-[optional domain linker]-VL2-scFv linker-VH2-[optional domain linker]-CH2-CH3. The second monomer comprises an Fc domain (CH2-CH3). This embodiment further utilizes a light chain comprising a variable light domain and a constant light domain that associates with the heavy chain to form a Fab.

As for many of the embodiments herein, these constructs include skew variants, pI variants, ablation variants, additional Fc variants, etc. as desired and described herein.

The present invention provides one armed central-scFv formats where the CD3 binding domain sequences are as shown FIG. 12 and the Sequence Listing. The present invention provides one armed central-scFv formats wherein the FAP binding domain sequences are as shown in FIGS. 13-15 and the Sequence Listing. Particularly useful FAP and CD3 sequence combinations for use with the central-Fv format are disclosed in FIGS. 43A and B.

In addition, the Fc domains of the one armed central-scFv format generally include skew variants (e.g., a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed central-scFv format includes skew variants, pI variants, and ablation variants. Accordingly, some embodiments of the one armed central-scFv formats comprise: a) a first monomer that comprises the skew variants S364K/E357Q, the ablation variants E233P/L234V/L235A/G236del/S267K, a variable heavy domain that, with the variable light domain of the light chain, makes up an Fv that binds to FAP as outlined herein, and a scFv domain that binds to CD3; b) a second monomer that includes an Fc domain having the skew variants L368D/ K370S, the pI variants N208D/Q295E/N384D/Q418E/ N421D, the ablation variants E233P/L234V/L235A/G236del/S267K; and c) a light chain comprising a variable light domain and a constant light domain.

In some embodiments, the one armed central-scFv format includes skew variants, pI variants, ablation variants and FcRn variants. Accordingly, some embodiments of the one armed central-scFv formats comprise: a) a first monomer that comprises the skew variants S364K/E357Q, the ablation variants E233P/L234V/L235A/G236del/S267K, the FcRn variants M428L/N434S, a variable heavy domain that, with the variable light domain of the light chain, makes up an Fv that binds to FAP as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

For one armed central-scFv formats, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

For one armed central-scFv formats, FAP binding domain sequences that are of particular use include, but are not limited to: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

7. One Armed scFv-mAb Format

One heterodimeric scaffold that finds particular use in the present invention is the one armed scFv-mAb format shown in FIG. 1D. In this embodiment, one monomer comprises just an Fc domain, while the other monomer uses a scFv domain attached at the N-terminus of the heavy chain, generally through the use of a linker: vh1-scFv linker-vl1-[optional domain linker]-VH2-CH1-hinge-CH2-CH3 or (in the opposite orientation) vl1-scFv linker-vh1-[optional domain linker]-VH2-CH1-hinge-CH2-CH3. In this format, the Fab portions binds FAP and the scFv binds CD3 or vice versa.

This embodiment further utilizes a light chain comprising a variable light domain and a constant light domain. The light chain associates with the heavy chain to form a Fab. As for many of the embodiments herein, these constructs include skew variants, pI variants, ablation variants, additional Fc variants, etc. as desired and described herein.

The present invention provides one armed scFv-mAb formats where the CD3 binding domain sequences are as shown in FIG. 12 and the Sequence Listing. The present invention provides one armed scFv-mAb formats wherein the FAP binding domain sequences are as shown in FIGS. 13-15 and the Sequence Listing. Particularly useful FAP and CD3 sequence combinations for use with the one armed scFv-mAb format are disclosed in FIGS. 43A and B.

In addition, the Fc domains of the one armed scFv-mAb format generally include skew variants (e.g., a set of amino acid substitutions as shown in FIGS. 3 and 8, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L, K370S:S364K/ E357Q, T366S/L368A/Y407V:T366W and T366S/L368A/ Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed scFv-mAb format includes skew variants, pI variants, and ablation variants. Accordingly, some embodiments of the one armed scFv-mAb formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to FAP as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one armed scFv-mAb format includes skew variants, pI variants, ablation variants and FcRn variants. Accordingly, some embodiments one armed scFv-mAb formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to FAP as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

For one armed scFv-mAb formats, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

For one armed scFv-mAb formats, FAP binding domain sequences that are of particular use include, but are not limited to: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

8. scFv-mAb Format

One heterodimeric scaffold that finds particular use in the present invention is the scFV-mAb format shown in FIG. 1E. In this embodiment, the format relies on the use of a N-terminal attachment of a scFv to one of the monomers, thus forming a third antigen binding domain, wherein the Fab portions of the two monomers bind FAP and the "extra" scFv domain binds CD3.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((vh1-scFv linker-vl1-[optional domain linker]-vh2-CH1-hinge-CH2-CH3) or (with the scFv in the opposite orientation) ((vl1-scFv linker-vh1-[optional domain linker]-vh2-CH1-hinge-CH2-CH3)). The second monomer comprises a heavy chain vh2-CH1-hinge-CH2-CH3.

This embodiment further utilizes a common light chain comprising a variable light domain and a constant light domain. The common light chain associates with the heavy chains to form two identical Fabs that bind FAP. As for many of the embodiments herein, these constructs include skew variants, pI variants, ablation variants, additional Fc variants, etc. as desired and described herein.

The present invention provides scFv-mAb formats where the CD3 binding domain sequences are as shown in FIG. 12 and the Sequence Listing. The present invention provides scFv-mAb formats wherein the FAP binding domain sequences are as shown in FIGS. 13-15 and the Sequence Listing. Particularly useful FAP and CD3 sequence combinations for use with the scFv-mAb format are disclosed in FIGS. 43A and B.

In addition, the Fc domains of the scFv-mAb format generally include skew variants (e.g., a set of amino acid substitutions as shown in FIGS. 3 and 8, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L, K370S:S364K/E357Q, T366S/L368A/Y407V:T366W and T366S/L368A/Y407V/Y349C:T366W/S354C), optionally ablation variants (including those shown in FIG. 5), optionally charged scFv linkers (including those shown in FIG. 7) and the heavy chain comprises pI variants (including those shown in FIG. 4).

In some embodiments, the scFv-mAb format includes skew variants, pI variants, and ablation variants. Accordingly, some embodiments include scFv-mAb formats that comprise: a) a first monomer that comprises the skew variants S364K/E357Q, the ablation variants E233P/L234V/L235A/G236del/S267K, a variable heavy domain that, with the variable light domain of the common light chain, makes up an Fv that binds to FAP as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to FAP as outlined herein; and c) a common light chain comprising a variable light domain and a constant light domain.

In some embodiments, the scFv-mAb format includes skew variants, pI variants, ablation variants and FcRn variants. Accordingly, some embodiments include scFv-mAb formats that comprise: a) a first monomer that comprises the skew variants S364K/E357Q, the ablation variants E233P/L234V/L235A/G236del/S267K, the FcRn variants M428L/N434S, a variable heavy domain that, with the variable light domain of the common light chain, makes up an Fv that binds to FAP as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to FAP as outlined herein; and c) a common light chain comprising a variable light domain and a constant light domain.

In some embodiments, the scFv-mAb antibody includes the mAb-scFv format backbone 1 sequence (optionally including M428L/N434S) from FIG. 10.

CD3 binding domain sequences finding particular use include, but are not limited to, anti-CD3 H1.30_L1.47, anti-CD3 H1.32_L1.47, anti-CD3 H1.89_L1.47, anti-CD3

H1.90_L1.47, anti-CD3 H1.33_L1.47 and anti-CD3 H1.31_L1.47, as well as those depicted in FIG. 12.

FAP binding domain sequences that are of particular use include, but are not limited to: 1A4A5 H1_L1; 1C3A5 H1_L1; 1E5A5 H1_L1; 1E5A5 (common light chain) H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

9. Dual scFv Format

The present invention also provides dual scFv formats as are known in the art and shown in FIG. 1B. In this embodiment, the FAP×CD3 heterodimeric bispecific antibody is made up of two scFv-Fc monomers (both in either (vh-scFv linker-vl-[optional domain linker]-CH2-CH3) format or (vl-scFv linker-vh-[optional domain linker]-CH2-CH3) format, or with one monomer in one orientation and the other in the other orientation.

The present invention provides dual scFv formats where the CD3 binding domain sequences are as shown in FIG. 12 and the Sequence Listing. The present invention provides dual scFv formats wherein the FAP binding domain sequences are as shown in FIGS. 13-15 and the Sequence Listing. Particularly useful FAP and CD3 sequence combinations for use with the dual scFv format are disclosed at FIGS. 43A and B.

In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, and a first scFv that binds either CD3 or FAP; and b) a second monomer that comprises the skew variants L368D/K370S, the pI variants N208D/Q295E/N384D/Q418E/N421D, the ablation variants E233P/L234V/L235A/G236del/S267K, and a second scFv that binds either CD3 or FAP.

In some embodiments, the dual scFv format includes skew variants, pI variants, ablation variants and FcRn variants. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, the FcRn variants M428L/N434S and a first scFv that binds either CD3 or FAP; and b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a second scFv that binds either CD3 or FAP.

For the dual scFv format, CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

For the dual scFv format, FAP binding domain sequences that are of particular use include, but are not limited to: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

10. Non-Heterodimeric Bispecific Antibodies

As will be appreciated by those in the art, the FAP and CD3 Fv sequences outlined herein can also be used in both monospecific antibodies (e.g., "traditional monoclonal antibodies") or non-heterodimeric bispecific formats (FIG. 1J).

CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

FAP binding domain sequences that are of particular use include, but are not limited to: 1A4A5 H1_L1; 1C3A5 H1_L1; 1E5A5 H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

Particularly useful FAP and CD3 sequence combinations for use with the non-heterodimeric antibody format are disclosed at FIGS. 43A and B.

Suitable non-heterodimeric bispecific formats are known in the art, and include a number of different formats as generally depicted in Spiess et al., Molecular Immunology (67):95-106 (2015) and Kontermann, mAbs 4:2, 182-197 (2012), both of which are expressly incorporated by reference and in particular for the figures, legends and citations to the formats therein.

11. Trident Format

Figure 1K:
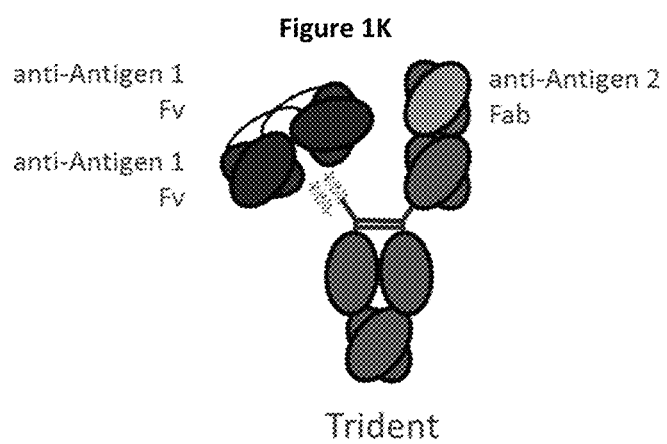

In some embodiments, the bispecific antibodies of the invention are in the "Trident" format as generally described in WO2015/184203, hereby expressly incorporated by reference in its entirety and in particular for the Figures, Legends, definitions and sequences of "Heterodimer-Promoting Domains" or "HPDs", including "K-coil" and "E-coil" sequences. Tridents rely on using two different HPDs that associate to form a heterodimeric structure as a component of the structure, see FIG. 1K. In this embodiment, the Trident format include a "traditional" heavy and light chain (e.g., VH1-CH1-hinge-CH2-CH3 and VL1-CL), a third chain comprising a first "diabody-type binding domain" or "DART®", VH2-(linker)-VL3-HPD1 and a fourth chain comprising a second DART®, VH3-(linker)-(linker)-VL2-HPD2. The VH1 and VL1 form a first ABD, the VH2 and VL2 form a second ABD, and the VH3 and VL3 form a third ABD. In some cases, as is shown in FIG. 1K, the second and third ABDs bind the same antigen, in this instance generally FAP, e.g., bivalently, with the first ABD binding a CD3 monovalently.

CD3 binding domain sequences finding particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

FAP binding domain sequences that are of particular use include, but are not limited to: 1A4A5 H1_L1; 1C3A5 H1_L1; 1E5A5 H1_L1; 1E5A5 (common light chain) H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

12. Monospecific, Monoclonal Antibodies

As will be appreciated by those in the art, the novel Fv sequences outlined herein can also be used in both monospecific antibodies (e.g., "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

In some embodiments, the monospecific antibody is a FAP monospecific antibody. In certain embodiments, the monospecific anti-FAP antibody includes the 6 CDRs of any of the anti-FAP antibodies selected from: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

In some embodiments, the monospecific FAP antibody includes the variable heavy domain and variable light domain of any of the anti-FAP antibodies selected from: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; and 1F10B5 H1_L1, as well as those depicted in FIGS. 13-15.

F. Antigen Binding Domains to Target Antigens

The subject bispecific antibodies have two different antigen binding domains (ABDs) that bind to two different antigens ("target pairs"), in either bivalent, bispecific formats or trivalent, bispecific formats as generally shown in FIG. 1. Note that generally these bispecific antibodies are named "anti-FAP×anti-CD3", or generally simplistically or for ease (and thus interchangeably) as "FAP×CD3", etc. for each pair. Note that unless specified herein, the order of the antigen list in the name does not confer structure; that is a FAP×CD3 1+1 Fab-scFv-Fc antibody can have the scFv bind to FAP or CD3, although in some cases, the order specifies structure as indicated.

As is more fully outlined herein, these combinations of ABDs can be in a variety of formats, as outlined below, generally in combinations where one ABD is in a Fab format and the other is in an scFv format. As discussed herein and shown in FIG. 1, some formats use a single Fab and a single scFv (e.g., FIGS. 1A, C and D, 1+1 Fab-scFv-Fc), and some formats use two Fabs and a single scFv (e.g., FIGS. 1E, F, and H, 2+1 Fab2-scFv-Fc).

In addition, in general, one of the ABDs comprises a scFv as outlined herein, in an orientation from N- to C-terminus of vh-scFv linker-vl or vl-scFv linker-vh. One or both of the other ABDs, according to the format, generally is a Fab, comprising a vh domain on one protein chain (generally as a component of a heavy chain) and a vl on another protein chain (generally as a component of a light chain).

As will be appreciated by those in the art, any set of 6 CDRs or vh and vl domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 7.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g., from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g., there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

1. FAP Antigen Binding Domains

As discussed above, the anti-FAP antibodies provided herein include one or more FAP antigen binding domains. The FAP binding domains provided herein exhibit a wide degree of affinity for FAP (see, e.g., FIGS. 45-49). In turn, subject antibodies that include such FAP binding domains advantageously elicit a range of different immune responses, depending on the particular FAP binding domain used. For example, the subject antibodies exhibit differences in selectivity for cells with different FAP expression, potencies for FAP expressing cells, ability to elicit cytokine release, and sensitivity to soluble FAP (see, e.g., Examples 6-8). Such FAP binding domains and related antibodies find use, for example, in the treatment of FAP associated cancers.

As will be appreciated by those in the art, suitable FAP binding domains can comprise a set of 6 CDRs as depicted in the Sequence Listing and figures, either as they are underlined or, in the case where a different numbering scheme is used as described herein and as shown in Table 2, as the CDRs that are identified using other alignments within the variable heavy (vh) domain and variable light domain (vl) sequences of those depicted in FIGS. 14 and 45. Suitable FAP ABDs can also include the entire vh and vl sequences as depicted in these sequences and figures, used as scFvs or as Fabs.

In one embodiment, the FAP antigen binding domain includes the 6 CDRs (i.e., vhCDR1-3 and vlCDR1-3) of any of the FAP binding domains described herein.

In addition to the parental CDR sets disclosed in the figures and sequence listing that form an ABD to FAP, provided herein are FAP ABDS having CDRs that are variants of the FAP ABD CDRs disclosed herein (e.g., FIGS. 14 and 45. In one embodiment, the FAP ABD includes a set of 6 CDRs with 1, 2, 3, 4 or 5 amino acid changes from a parental FAP ABD CDRs (see, e.g., FIGS. 14 and 45). In certain embodiments, the FAP ABD is capable of binding FAP antigen, as measured by at least one of a Biacore, surface plasmon resonance (SPR) and/or BLI (biolayer interferometry, e.g., Octet assay) assay, with the latter finding particular use in many embodiments.

In one embodiment, the FAP antigen binding domain includes the 6 CDRs (i.e., vhCDR1-3 and vlCDR1-3) of a FAP ABD, wherein the FAP ABD is one of the following FAP ABDs: 1A4A5 H1_L1; 1C3A5 H1_L1; 1E5A5 H1_L1; 1E5A5 (common light chain)H1_L1; 1A1B5 H1_L1;

1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

In another exemplary embodiment, the FAP ABD include the variable heavy (VH) domain and variable light (VL) domain of any one of the FAP ABDs disclosed herein (see, e.g., FIGS. 14 and 45).

In addition to the parental FAP variable heavy and variable light domains disclosed herein, provided herein are FAP ABDs that include a variable heavy domain and/or a variable light domain that are variants of a FAP ABD VH and VL domain disclosed herein.

In one embodiment, the variant VH domain and/or VL domain has from 1, 2, 3, 4, 5, 6, 7, 8, 9 or 10 amino acid changes from a parental VH and VL domain of a FAP ABD depicted in FIG. 14 or 45. In certain embodiments, the FAP ABD is capable of binding to FAP, as measured at least one of a Biacore, surface plasmon resonance (SPR) and/or BLI (biolayer interferometry, e.g., Octet assay) assay, with the latter finding particular use in many embodiments.

In another embodiment, the variant VH and/or VL domain is at least 90, 95, 97, 98 or 99% identical to the VH and/or VL of a FAP ABD as depicted in FIG. 14 or 45.

In certain embodiments, the FAP ABD is capable of binding to the FAP, as measured by at least one of a Biacore, surface plasmon resonance (SPR) and/or BLI (biolayer interferometry, e.g., Octet assay) assay, with the latter finding particular use in many embodiments.

In some embodiments, the FAP ABD of the anti-FAP antibody includes the VH and VL of a FAP ABD, where the FAP ABD is one of the following FAP ABDs: 1A4A5 H1_L1; 1C3A5 H1_L1; 1E5A5 H1_L1; 1E5A5 (common light chain)H1_L1; 1A1B5 H1_L1; 1A7B5 H1_L1; 1F4B5 H1_L1; 1F11B5 H1_L1; 1F12B5 H1_L1; 1D5B5 H1_L1; 1F10B5 H1_L1; XENP23533 (aFAP H0_L0); XENP24774 (aFAP H0.1_L0); XENP24775 (aFAP H0.2_L0); XENP24776 (aFAP H0.3_L0); XENP24777 (aFAP H0.4_L0); XENP24778 (aFAP H0.5_L0); XENP24779 (aFAP H0.6_L0); XENP24780 (aFAP H0.7_L0); XENP24781 (aFAP H0.8_L0); XENP24782 (aFAP H0.9_L0); XENP24783 (aFAP H0.10_L0); XENP24784 (aFAP H0.11_L0); XENP24785 (aFAP H0.12_L0); XENP247836 (aFAP H0.13_L0); XENP24787 (aFAP H0.14_L0); XENP24788 (aFAP H0.15_L0); XENP24789 (aFAP H0.16_L0); XENP24790 (aFAP H0.17_L0); XENP24791 (aFAP H0.18_L0); XENP24792 (aFAP H0.19_L0); XENP24793 (aFAP H0.20_L0); XENP24794 (aFAP H0.21_L0); XENP24795 (aFAP H0.22_L0); XENP24796 (aFAP H0.23_L0); XENP24801 (aFAP H0.24_L0); XENP25264 (aFAP H0.25_L0); XENP25265 (aFAP H0.26_L0); XENP27885 (aFAP H0_L0.1); XENP27886 (aFAP H0_L0.2); XENP27887 (aFAP H0_L0.3); XENP27888 (aFAP H0_L0.4); XENP27889 (aFAP H0_L0.5); XENP27890 (aFAP H0_L0.6); XENP27891 (aFAP H0_L0.7); XENP27892 (aFAP H0_L0.8); XENP27893 (aFAP H0_L0.9); XENP27894 (aFAP H0_L0.10); XENP27895 (aFAP H0_L0.11); XENP27896 (aFAP H0_L012); XENP27897 (aFAP H0_L0.13); XENP27898 (aFAP H0_L0.14); XENP27899 (aFAP H0_L0.15); XENP27900 (aFAP H0_L0.16); XENP27901 (aFAP H0_L0.17); XENP27902 (aFAP H0_L0.18); XENP27903 (aFAP H0_L0.19); XENP27904 (aFAP H0_L0.20); XENP27905 (aFAP H0_L0.21); XENP27906 (aFAP H0_L0.22); XENP27907 (aFAP H0_L0.23); XENP27908 (aFAP H0_L0.24); XENP27909 (aFAP H0_L0.25); XENP27910 (aFAP H0_L0.26); XENP27911 (aFAP H0_L0.27); XENP27912 (aFAP H0_L0.28); XENP27913 (aFAP H0_L0.29); XENP27914 (aFAP H0_L0.30); XENP27915 (aFAP H0_L0.31); XENP27916 (aFAP H0_L0.32); XENP27917 (aFAP H0_L0.33); XENP27918 (aFAP H0_L0.34); XENP27919 (aFAP H0_L035); XENP27920 (aFAP H0_L0.36); XENP27921 (aFAP H0_L0.37); XENP27922 (aFAP H0_L0.38); XENP27923 (aFAP H0_L0.39); XENP27924 (aFAP H0_L0.40); XENP27251 (aFAP H0_L0.41); XENP27926 (aFAP H0_L0.42); XENP27927 (aFAP H0_L0.43); XENP27928 (aFAP H0_L0.45); XENP27929 (aFAP H0_L1(CLC)); XENP27964 (aFAP H0.13_L0.11); XENP27965 (aFAP H0.13_L0.14); XENP27966 (aFAP H0.13_L0.19); XENP27967 (aFAP H0.13_L0.41); XENP27968 (aFAP H0.26_L0.11); XENP27969 (aFAP H0.26_L0.14); XENP27970 (aFAP H0.26_L0.19); and XENP27971 (aFAP H0.26_L0.41) (FIGS. 14 and 45).

2. CD3 Antigen Binding Domains

In some embodiments, one of the ABDs binds CD3. Suitable sets of 6 CDRs and/or vh and vl domains, as well as scFv sequences, are depicted in FIGS. 12 and 13 and the Sequence Listing. CD3 binding domain sequences that are of particular use include, but are not limited to, anti-CD3 H1.30_L1.47, anti-CD3 H1.32_L1.47, anti-CD3 H1.89_L1.47, anti-CD3 H1.90_L1.47, anti-CD3 H1.33_L1.47 and anti-CD3 H1.31_L1.47, as well as those depicted in FIG. 12.

As will be appreciated by those in the art, suitable CD3 binding domains can comprise a set of 6 CDRs as depicted in the Sequence Listing and Figures, either as they are underlined or, in the case where a different numbering scheme is used as described herein and as shown in Table 2, as the CDRs that are identified using other alignments within the vh and vl sequences of those depicted in FIG. 12. Suitable ABDs can also include the entire vh and vl sequences as depicted in these sequences and Figures, used as scFvs or as Fabs. In many of the embodiments herein that contain an Fv to CD3, it is the scFv monomer that binds CD3.

In addition to the parental CDR sets disclosed in the figures and sequence listing that form an ABD to CD3, the invention provides variant CDR sets. In one embodiment, a set of 6 CDRs can have 1, 2, 3, 4 or 5 amino acid changes from the parental CDRs, as long as the CD3 ABD is still able to bind to the target antigen, as measured by at least one of a Biacore, surface plasmon resonance (SPR) and/or BLI (biolayer interferometry, e.g., Octet assay) assay, with the latter finding particular use in many embodiments.

In addition to the parental variable heavy and variable light domains disclosed herein that form an ABD to CD3, the invention provides variant vh and vl domains. In one embodiment, the variant vh and vl domains each can have from 1, 2, 3, 4, 5, 6, 7, 8, 9 or 10 amino acid changes from the parental vh and vl domain, as long as the ABD is still able to bind to the target antigen, as measured at least one of a Biacore, surface plasmon resonance (SPR) and/or BLI (biolayer interferometry, e.g., Octet assay) assay, with the latter finding particular use in many embodiments. In another embodiment, the variant vh and vl are at least 90, 95, 97, 98 or 99% identical to the respective parental vh or vl, as long as the ABD is still able to bind to the target antigen, as measured by at least one of a Biacore, surface plasmon resonance (SPR) and/or BLI (biolayer interferometry, e.g., Octet assay) assay, with the latter finding particular use in many embodiments.

In some embodiments, the bispecific antibody includes an H1.30_L1.47 CD3 antigen binding domain as a scFv included within any of the 1+1 Fab-scFv-Fc format backbones of FIG. 9. In some embodiments, the bispecific antibody includes an H1.32_L1.47 CD3 antigen binding domain as a scFv included within any of the 1+1 Fab-scFv-Fc format backbones of FIG. 9.

In some embodiments, the bispecific antibody includes an H1.30_L1.47 CD3 antigen binding domain as a scFv included within the 2+1 Fab2-scFv-Fc backbone of FIG. 10 (see also FIG. 63). In some embodiments, the bispecific antibody includes an H1.32_L1.47 CD3 antigen binding domain as a scFv included within the central-scFv format backbone format backbones of FIG. 10 (see also FIG. 63).

VI. Useful Embodiments

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprises Q295E/N384D/Q418E/N481D and the other a positively charged scFv linker (when the format includes an scFv domain). As will be appreciated in the art, the "knobs in holes" variants do not change pI, and thus can be used on either monomer.

VII. Nucleic Acids

In another aspect, provided herein are nucleic acid compositions encoding FAP binding domains and anti-FAP antibodies (FAP×CD3 bispecific antibodies and FAP monospecific antibodies).

As will be appreciated by those in the art, the nucleic acid compositions will depend on the format and scaffold of the heterodimeric protein. Thus, for example, when the format requires three amino acid sequences, such as for the 1+1 Fab-scFv-Fc or 2+1 Fab2-scFv-Fc formats, three nucleic acid sequences can be incorporated into one or more expression vectors for expression. Similarly, some formats (e.g., dual scFv formats such as disclosed in FIG. 1) only two nucleic acids are needed; again, they can be put into one or two expression vectors.

As is known in the art, the nucleic acids encoding the components of the FAP binding domains and FAP antibodies disclosed herein can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g., CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in U.S. 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "1+1 Fab-scFv-Fc" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

VIII. Biological and Biochemical Functionality of the Heterodimeric FAP×CD3 Antibodies Generally the bispecific FAP×CD3 antibodies described herein are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. Treatments Once made, the compositions of the invention find use in a number of applications. FAP is found to be generally elevated in cancer associated fibroblasts (CAFs) in comparison with normal tissue. CAFs are involved in tumor survival and proliferation, for example by providing growth factors for angiogenesis and by encouraging an immunosuppressive environment, and have been associated with poor prognosis. Thus, FAP is a suitable target for cancer therapies. Accordingly, the heterodimeric compositions of the invention find use in the treatment of cancers that involve FAP positive CAFs.

A. Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

B. Administrative Modalities

The antibodies and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

Example 1: FAP as a Suitable Antigen for Targeting Tumor Stromal Fibroblasts

Background

Antibody-based therapeutics have been used successfully to treat a variety of diseases, including cancer. An increasingly prevalent avenue being explored is the engineering of single immunoglobulin molecules that co-engage two different antigens. Such alternate antibody formats that engage two different antigens are often referred to as bispecific antibodies. Because the considerable diversity of the antibody variable region (Fv) makes it possible to produce an Fv that recognizes virtually any molecule, the typical approach to bispecific antibody generation is the introduction of new variable regions into the antibody.

A particularly useful approach for bispecific antibodies is to engineer a first binding domain which engages CD3 and a second binding domain which engages an antigen associated with or upregulated on cancer cells so that the bispecific antibody redirects $CD3^+$ T cells to destroy the cancer cells. However, tumor cells may shed these antigens as part of cancer immunoediting (Hochst and Diehl, 2012) contributing to their immune escape and decreasing the efficacy of such treatments which target cancer-associated antigens. Therefore, another approach is to target other cells in the tumor environment known to support tumor cell survival.

Fibroblasts represent a majority of stromal cells in the tumor environment. These cancer-associated fibroblasts (CAFs) have been reported to promote tumor survival and proliferation (Orimo et al., 2006; Xing et al., 2011), for example by providing growth factors for angiogenesis and by encouraging an immunosuppressive environment, and have been associated with poor prognosis (Underwood et al, 2015). Accordingly, there have been attempts to destroy tumors by targeting CAFs, although thus far, such treatments have been ineffective in clinical trials (Barnett and Vilar, 2018).

Fibroblast activation protein (FAP) is a serine protease involved in extracellular matrix remodeling (Kelly et al. 2012). FAP has been found to be highly expressed in CAFs (Scanlan et al., 1994). A number of FAP-targeting therapies have been developed to target CAFs, such as anti-FAP mAb sibrotuzumab and FAP-CAR-T. Sibrotuzumab, while shown to successfully target CAFs without adverse effect, did not meet the minimal requirement for clinical trial continuation of at least one complete or partial remission in an early Phase II trial (Scott et al., 2003; Hofheinz et al., 2003). On the other hand, preclinical data featuring adoptive transfer of FAP-CAR-T cells (both human and mouse) based on anti-mouse FAP antibody 73.3 was shown to successfully restrict tumor growth both in mouse engrafted with human mesothelioma cells as well as in mouse engrafted with murine pancreatic cancer cells. However, a separate study using anti-murine FAP-CAR-T cells based on the FAP5 mAb in mouse tumor models resulted in bone marrow toxicity and cachexia (Tran et al., 2013). Therefore, there is a need and potential for effective therapy targeting CAFs with enhanced safety profiles.

1A: FAP is Upregulated in Tumor Tissue in Comparison to Matched-Normal Tissue

In seeking to identify suitable antigens for targeted destruction of the tumor stroma, RNA sequencing data from The Cancer Genome Atlas project (TCGA) were used to investigate transcription levels for CAF-associated antigens on tumor tissue versus matched-normal tissue. V2 RSEM data were downloaded from FireBrowse (http://firebrowse.org), and analysis was performed using R with custom routines. The FAP transcription levels on tumor tissue and matched-normal tissue associated with various cancers are depicted in FIG. 22. The data show that with the exception of several cancers (e.g. cervical squamous cell carcinoma, pancreatic adenocarcinoma, thymoma, and uterine corpus endometrial carcinoma), FAP transcription levels are generally elevated in tumor tissue in comparison to matched-normal tissue. And in the case of pancreatic adenocarcinoma, FAP transcription level is greatly elevated in cancer tissue than in comparison to most other normal tissues. This suggests that targeting FAP on tumor-associated stromal fibroblasts should result in minimal on-target/off-tumor toxicity.

1B: FAP Expression Level in Various Cell Lines

Next, FAP expression level on a number of cell lines was investigated. In a first experiment, 500K cells from Detroit-551 (normal skin fibroblast), BJ human fibroblast (normal skin fibroblast), IMR-90 (normal lung fibroblast), HFL-1 (normal lung fibroblast—fetal), NCI-H196 (small cell lung cancer, derived from metastatic site: pleural effusion), U937 (histiocytic lymphoma), HCC1143 (primary ductal carcinoma, TNMA stage IIA, grade 3), WI-38 (normal lung fibroblast—fetal), SK-MEL-3 (malignant melanoma, derived from metastatic site: lymph node), NCI-H661 (large cell lung carcinoma, derived from metastatic site: lymph node), HL60 (acute promyelocytic leukemia), HT29 (colorectal adenocarcinoma), and A549 (lung carcinoma) cell lines were incubated with multiple concentrations (4, 2, 1 and 0.5 µg/ml) of mouse anti-human FAP (R&D Systems, Minneapolis, Minn.) on ice for 1 hour. Cells were washed twice with ice cold PBS and then stained with Dako QIFIKIT® detection antibody (Agilent, Santa Clara, Calif.) on ice for 45 minutes and according to the manufacturer's instructions. Following staining, cells were washed twice with PBS and re-suspended in 200 µl FACS buffer (1% PFA in PBS) and analyzed by flow cytometry on a FACSCanto cytometer (BD Biosciences, San Jose, Calif.). FAP antigen number on the various cell lines are depicted in FIG. 24.

In another experiment, 200K cells from WI-38, IMR-90, Detroit551, HFL-1, BJ human fibroblast, SW872 and NCI-H196 cell lines were stained with multiple concentrations of antibody, either mouse anti-FAP-APC (R&D Systems, Minneapolis, Minn.) or anti-mouse IgG-APC (R&D Systems, Minneapolis, Minn.) as an isotype control, on ice for an hour. Following staining, samples were washed once with PBS and re-suspended in 200 µl FACS buffer and analyzed by flow cytometry. APC MFI indicating binding by anti-FAP antibody or isotype control antibody are depicted in FIG. 25.

1C: WI-38 as a Bone Marrow Stem Cell Surrogate

Tran et al., J. Exp. Med. 210(6): 1125-1135 (2013) reported cachexia and bone marrow toxicity in mice following treatment with anti-FAP-CAR-T cells comprising the scFv from the FAPS mAb. In particular, they found that murine bone marrow stem cells expressed FAP and were targeted for destruction by FAP5-CAR-T. Therefore, it is important to ensure that novel FAP targeting therapies do not destroy bone marrow stem cells such as mesenchymal stromal cells (MSCs) and hematopoietic stem cells (HSCs). FAP expression levels on MSCs and HSCs was investigated. 100 µl of bone marrow aspirates from 5 separate donors were labeled with anti-CD4-PercP/Cy5.5 (OKT5), anti-CD8-PercP/Cy5.5 (RPA-T8), anti-CD14-PercP/Cy5.5 (M5E2), anti-CD16-PercP/Cy5.5 (3G8), anti-CD56-PercP/Cy5.5 (MY31), anti-CD20-PercP/Cy5.5 (2H7), anti-CD105-PE (SN6), anti-CD73-APC (AD2), anti-CD90-BV421 (5E10), anti-CD34-BUV395 (563), anti-CD133-PE-Vio615 (AC133), anti-CD31-BV605 (WM59), anti-CD45-AF700 (D058-1283), anti-CD117-BV711 (104D2), anti-CD11b-BV786 (1CRF44), and anti-FAP-Alexa488 (either XENP23534, XENP24460, or XENP24861, which were in-house purified and labeled). Following incubation with the staining antibodies, ACL lysis buffer was added to the mixture to lyse red blood cells. Finally, the cells were fixed in FACS buffer and analyzed by flow cytometry on a BD Fortessa X-20 (BD Biosciences, San Jose, Calif.). MSCs were defined as lineage negative (CD4$^-$CD8$^-$CD14$^-$CD16$^-$CD56$^-$CD20$^-$) and CD34$^-$CD105$^+$CD90$^+$CD73$^+$, and HSCs were defined as lineage negative and CD34$^+$CD105$^-$. A lineage negative CD31$^+$ population was also identified, a subpopulation of which was positive for FAP. Finally, FAP expression on MSCs, HSCs, and lineage negative CD31$^+$ FAP$^+$ cells (as well as WI-38, HFL-1, and Detroit-551 cells) was evaluated according to the MFI from binding of the anti-FAP antibodies, data for which are depicted in FIG. 26. While the data confirm that MSCs and HSCs (as well as a subpopulation of lineage negative CD31$^+$ cells) have elevated levels of FAP, the data also show that FAP levels are less than that of WI-38, indicating that WI-38 could be a suitable surrogate for cell types to be avoided by novel FAP-targeting therapies.

Example 2: Anti-FAP×Anti-CD3 Bispecific Antibodies

We investigated the potential of using anti-FAP×anti-CD3 bispecific antibodies (bsAbs) to redirect CD3$^+$ effector T cells to destroy tumor stromal fibroblasts. Towards this, anti-FAP×anti-CD3 bsAbs were generated using the variable regions from prior art anti-FAP antibodies such as sibrotuzumab (see, e.g., U.S. Pat. No. 6,455,677, issued Sep. 24, 2002), 29B11 and 3F2 (see, e.g., WO 2012/020006, published Feb. 16, 2012), sequences for which are depicted in FIG. 13. Sequences for anti-CD3 scFvs used in the bsAbs are included in FIG. 12.

2A: Generation of Anti-FAP×Anti-CD3 Bispecific Antibodies

Schematics for illustrative anti-FAP×anti-CD3 bsAbs are depicted in FIG. 16. FIG. 16A depicts the "1+1 Fab-scFv-Fc" format which comprises a single-chain Fv ("scFv") recombinantly fused to one side of a heterodimeric Fc, a heavy chain variable region (VH) recombinantly fused to the other side of the heterodimeric Fc, and a light chain (LC) transfected separately so that a Fab domain is formed with the variable heavy domain. FIG. 16B depicts the "2+1 Fab2-scFv-Fc" format which comprises a VH domain recombinantly fused to an scFv fused to one side of a heterodimeric Fc, a VH domain recombinantly fused to the other side of the heterodimeric Fc, and a LC transfected separately so that Fab domains are formed with the VH domain.

DNA encoding the anti-FAP variable heavy chain variable and variable light domains was generated by gene synthesis and subcloned into a pTT5 expression vector containing appropriate fusion partners (e.g., constant regions or anti-CD3 scFv-Fc). DNA encoding anti-CD3 scFv-Fc heavy chains was generated by gene synthesis. DNA was transfected into HEK293E cells for expression. Sequences are depicted in FIGS. 17 and 18. An anti-RSV×anti-CD3 bispecific antibody was also generated as a control, sequences for which are depicted in FIG. 19.

2B: Binding of FAP by Prototype Anti-FAP×Anti-CD3 bsAbs

Illustrative anti-FAP×anti-CD3 bsAbs produced as described above were screened for binding to human and cynomolgus FAP using Octet. Experimental steps for Octet generally included the following: Immobilization (capture of ligand to a biosensor); Association (dipping of ligand-coated biosensors into wells containing serial dilutions of the analyte); and Dissociation (returning of biosensors to well containing buffer) in order to determine the affinity of the test articles. A reference well containing buffer alone was also included in the method for background correction during data processing. In particular, HIS 1K biosensors were used to capture His-tagged human FAP (see FIG. 2A for human FAP sequence) or His-tagged cynomolgus FAP (see FIG. 2C for predicted cynomolgus FAP sequence) and dipped into multiple concentrations of each bispecific antibody to determine $K_D$ as depicted in FIG. 27.

2C: Characterization of Anti-FAP×Anti-CD3 bsAbs with Anti-FAP Binding Domain Derived from Sibrotuzumab 2C(a): Binding on Cells with Different FAP Expression Levels To investigate the binding of prototype anti-FAP (variable regions from sibrotuzumab)×anti-CD3 bsAbs to FAP-expressing cell lines, 200K cells from WI-38 (low FAP expression), SW872 (low FAP expression), HFL-1 (high-intermediate FAP expression), and Detroit-551 (high FAP expression) cell lines were incubated with multiple concentrations of indicated test articles on ice for an hour. Controls include incubation without any test articles and incubation with an anti-RSV×anti-CD3-High bsAb (XENP13245). Following incubation with test articles, samples were stained with a secondary detection antibody and analyzed by flow cytometry. PE MFI indicating binding by the bsAbs are depicted in FIG. 28, and FIG. 29 depicts the EC50 for cell-binding on the cell lines. The data show that the 1+1 Fab-scFv-Fc format binds to the cells more than the 2+1 Fab2-scFv-Fc format, suggesting that the high-affinity FAP binding activity characteristic of the binding domain derived from sibrotuzumab abrogates the avidity effect expected of the 2+1 Fab2-scFv-Fc format. Instead, the monovalency of the 1+1 Fab-scFv-Fc format allows for more bsAbs to bind, resulting in a higher PE MFI. Abrogation of avidity effect is also observed on cells with high FAP levels e.g. Detroit-551.
2C(b): Redirected T cell cytotoxicity on cells with different levels of FAP expression Next, we investigated redirected T cell cytotoxicity (RTCC) by prototype anti-FAP (variable regions from sibrotuzumab)×anti-CD3 bsAbs on cell lines with different FAP expression levels. WI-38, SW872, HFL-1, and Detroit-551 were incubated with human PBMCs and the indicated test articles at 37° C. for 24 hours at an effector:target ratio of 10:1. RTCC was determined using CytoTox-ONE™ Homogeneous Membrane Integrity Assay (Promega, Madison, Wis.) to measure lactate dehydrogenase levels according to manufacturer's instructions and data was acquired on a Wallac Victor2 Microplate Reader (PerkinElmer, Waltham, Mass.).

The data depicted in FIG. 30 Indicate that the RTCC Potency of the bsAbs is dependent on the affinity of the anti-CD3 scFv. Notably, on WI-38 and SW872 which are cells expressing lower levels of FAP, the 2+1 Fab2-scFv-Fc format was generally more potent in inducing RTCC than the 1+1 Fab-scFv-Fc format due to the extra avidity conveyed by the 2+1 Fab2-scFv-Fc format. On cells with higher FAP levels such as HFL-1 and Detroit-551, the avidity effect is diminished.
2D: RTCC by Additional Prototype Anti-FAP×Anti-CD3 bsAbs with Different Anti-FAP Binding Domains To investigate the effect of using alternative anti-FAP binding domains, prototype anti-FAP×anti-CD3 bsAbs with anti-FAP variable regions derived from sibrotuzumab, 29B11, or 3F2 were compared in vitro for RTCC on various cell lines as generally described above in Example 2C(b).

In a first experiment, cells expressing high levels of FAP (Detroit-551, BJ human fibroblast, IMR-90, and HFL-1) were incubated with human PBMCs and the indicated test articles at 37° C. for 24 hours at an effector:target ratio of 10:1. The data depicted in FIG. 31 show that each of the FAP expressing cell lines were killed by anti-FAP bsAbs in various formats. Consistent with the results described in Example 2C(b), the 2+1 Fab2-scFv-Fc format is more potent that the 1+1 Fab-scFv-Fc format for each of the anti-FAP binding domains. Notably, the bsAbs based on 29B11 was more potent than the bsAbs based on 3F2, indicating that RTCC potency may also dependent on the affinity of the anti-FAP binding domain.

In another experiment, cells expressing low levels of FAP (WI-38 and SW872) were incubated with human PBMCs and the indicated test articles at 37° C. for 24 hours at an effector:target ratio of 10:1. RTCC was determined as described above, and data are depicted in FIG. 32.

Example 3: Generation of Additional FAP Antigen Binding Domains

In addition to reporting bone marrow toxicity resulting from treatment with their FAP5-CAR-T cells, Tran et al. (2013) notes that several other preclinical studies targeting FAP did not report significant toxicities. They hypothesize that the lack of toxicity could be due to differences in potency and/or targeted FAP epitope. Further, as noted in Example 2D, the affinity of the anti-FAP binding domain can impact on the RTCC potency of the bispecific antibodies. Accordingly, we generated additional FAP antigen binding domains (ABDs) to identify ABDs with a range of affinity and which bound different epitopes than FAP5.
3A: Phage display library Recombinant human, cynomolgus, and murine FAP (see FIG. 2 for sequences) with histidine tags were generated in-house for phage panning. Plasmids coding for the antigens were constructed by Gibson assembly in a pTT5 vector. After transient transfection of HEK293E cells, the secreted antigens were purified via NiNTA chromatography.

In-house de novo phage libraries were built displaying Fab and scFv variants on phage coat protein pIII, and were panned in 5 rounds against human, cyno, and murine FAP. Prior to the first round and after each round, phage were added to log-phase XL1-Blue cells (Agilent, Wilmington, Del.) and incubated overnight at 37° C., 250 rpm. Fab and scFv clones were sequences for their VH and VL identity, from which plasmids were constructed by Gibson assembly and subcloned into a pTT5 expression vector containing the coding sequence for the IgG1 constant regions. DNA was transfected in HEK293E for expression, and antibodies were purified by Protein A chromatography. The amino acid sequences for exemplary phage-derived clones formatted as bivalent mAbs are depicted in FIG. 15.
3B: Affinity Screen of Phage-Derived Anti-FAP Antibodies Phage-derived anti-FAP antibodies were screened for affinity prior to purification by Octet as generally described in Example 2B. In particular, anti-human IgG-Fc (AHC) biosensors were used to capture 1:5 dilutions of supernatant from HEK293E culture and dipped into 100 nM of human, cyno, or murine FAP. Results for selected phage-derived anti-FAP antibodies are depicted in FIG. 33. The data show that the clones display a range of FAP binding activity, and several of the clones were cross-reactive for murine FAP.
3C: Phage-Derived Anti-FAP Antibodies do not Non-Specifically Bind to DPP4

DPP4 (sequence depicted in FIG. 22) is a FAP homologue with 68% identity. To further avoid off-target toxicity, we used Octet to investigate whether the phage-derived anti-FAP binding domains were cross-reactive with DPP4. HIS 1K biosensor was used to capture His-tagged DPP4 (Sino Biological, Beijing, China) and dipped into 100 nM of phage-derived anti-FAP mAbs. Overlay of sensorgrams depicting binding of each test article to DPP4 is depicted in FIG. 34. The data show that none of the phage-derived anti-FAP antibodies bound to DPP4.
3D: Phage-Derived Anti-FAP Binding Domains do not Bin to the Same Epitope as FAP5 and Sibrotuzumab Next, we used Octet to identify clones which did not bin to the same epitope as FAP5. HIS 1K biosensors were first used to capture Histidine-tagged human FAP, dipped into a first antibody (listed on the left of the table in FIG. 35) and then dipped into a second antibody (listed on the top of the table in FIG. 35). BLI-responses were normalized against the BLI-response of dipping the biosensor into HBS-EP buffer followed by dipping into the second anti-FAP antibody. If the second antibody provided a normalized BLI-response less than 0.41, the two antibodies were considered to be in the same epitope bin, i.e., recognizing very similar, or largely overlapping, epitopes. The normalized BLI-response for each of the phage pairs are summarized in FIG.

35. The binning shows that none of the phage-derived anti-FAP binding domains binds to the same/similar epitope as either FAP5 or sibrotuzumab.

3E: Phage-Derived Anti-FAP Clones do not Compete for Binding with Sibrotuzumab on WI-38 Cells To investigate whether phage-derived anti-FAP clones competed for binding with sibrotuzumab on FAP-expressing cells, 200K WI-38 cells were incubated with multiple concentrations of the indicated test articles on ice for 30 minutes. Following incubation, AlexaF488-labeled XENP23534 (sibrotuzumab) was added and incubated for an extra 30 minutes. Next, samples were washed once with ice cold PBS and re-suspended in 150 l ice cold FACS buffer and analyzed by flow cytometry. The data in FIG. 36 depicting AlexaF488 MFI (indicating binding by XENP23534 after incubation with the indicated test articles) show that none of the phage-derived anti-FAP clones competed for binding with sibrotuzumab.

Example 4: Characterizing Additional Anti-FAP (Phage-Derived)×Anti-CD3 Bispecific Antibodies Additional anti-FAP×anti-CD3 bsAbs were generated with phage-derived FAP binding domains as generally described in Example 2A. An additional anti-FAP binding domain based on clone 1E5A5, but with the light chain replaced with human germline VLk 1-39 and J chain sequence, was also used. Sequences for illustrative bispecific antibodies are depicted in FIGS. 20 and 21.

4A: Redirected T-Cell Cytotoxicity on FAP-Expressing Cell Lines by 1+1 Fab-scFv-Fc Bispecific Abs with Phage-Derived Anti-FAP Binding Domains Investigation of RTCC by phage-derived anti-FAP binding domains formatted as either bivalent mAbs (with ablated effector function) or anti-FAP×anti-CD3 bsAbs in the 1+1 Fab-scFv-Fc format was performed as generally described in Example 2C(b). Detroit-551, SW872, or WI-38 cells were incubated with human PBMCs and the indicated test articles at 37° C. for 24 hours at an effector:target ratio of 10:1. The data depicted in FIG. 37 show that a number of the bsAbs with phage-derived anti-FAP binding domains induced killing of the FAP-expressing cells, while the bivalent mAbs with ablated effector function did not induce killing of the FAP-expressing cells. Additionally, the data show that RTCC was generally more potently induced on the cells with high FAP expression levels (i.e. Detroit-551) than on the cells with lower FAP expression levels (i.e. SW872 and WI-38).

4B: Redirected T-Cell Cytotoxicity on FAP-Expressing Cell Lines by Anti-FAP (Phage-Derived)×anti-CD3 in various formats Next in a number of experiments, selected phage-derived anti-FAP binding domains were formatted as part of anti-FAP×anti-CD3 bsAbs in the 1+1 Fab-scFv-Fc format and in the 2+1 Fab2-scFv-Fc format with anti-CD3 scFv with high or high-intermediate affinity and investigated for RTCC on FAP-expressing cells as generally described in Example 2C(b). Data are depicted in FIGS. 38-40. The data show that several of the anti-FAP×anti-CD3 bsAbs, including XENP25193, XENP25195, XENP25967, and XENP25194, induced potent RTCC on cell lines with high FAP expression (e.g. BJ human fibroblast and HFL-1), and minimal or substantially reduced RTCC activity on cell lines with low FAP expression (e.g. WI-38, which as described in Example 1C, was selected as a surrogate for cell types to avoid).

Example 5: Pilot Study in Cynomolgus Monkeys

A pilot study in cynomolgus monkeys was performed to investigate in vivo characteristics of exemplary anti-FAP× anti-CD3 bsAbs such as T cell redistribution. 10 groups of monkeys (n=3) were administered a single intravenous (i.v.) dose of exemplary phage-derived bsAbs at either low or high doses, as well as XENP23535 and XENP23536 as sibrotuzumab-derived controls.

T cell redistribution from peripheral blood was assessed as an indicator of T cell redirection to FAP-expressing cells by the bsAbs of the invention. Peripheral blood was first stained with anti-CD3-BUV395 (SP-34-2), anti-CD4-APC (OKT4), anti-CD8-PerCP-Cy5.5 (RPA-T8), anti-CD16-BV421 (3G8), anti-CD66-APC-Cy7 (TET2), and anti-CD45-AF700 (D058-1283) antibodies to gate for various cell populations. Counts for CD4 and CD8 expressing cells are depicted in FIGS. 41 and 42. The data show swift redistribution of $CD4^+$ and $CD8^+$ lymphocytes from peripheral blood after dosing with phage-derived bsAbs indicating target-dependent T cell redirection.

Example 6: Tuning Affinity of FAP Binding Domain to Further Enhance Selectivity

To recap the findings above, bsAbs in the 2+1 Fab2-scFv-Fc format can be tuned (e.g. by reducing the CD3 binding affinity and/or the tumor antigen binding affinity) to be highly selective for cells with high tumor antigen density over cells with low tumor antigen density, while untuned bsAbs in the 1+1 Fab-scFv-Fc format having high CD3 and tumor antigen binding affinity are more broadly reactive. Illustrative data for XENP23535 and XENP25967 as presented in Example 2D (FIGS. 31 and 32) and Example 4 (FIG. 38-40) are represented in FIG. 44 to highlight this finding. XENP23535, which has both high affinity CD3 binding and high affinity FAP binding, induces potent RTCC activity on cells having both high and low density FAP expression. On the other hand for XENP25967, while both the CD3 binding and the FAP binding affinity are reduced, the avidity provided by the 2+1 format enables the molecule to still induce RTCC activity on cells with high density FAP expression while avoiding cells with low density FAP expression. In line with this, the data as presented in Example 2C(b)-2D collectively indicate that high-affinity tumor antigen binding may abrogate the avidity effect and reduce selectivity at lower concentrations. Accordingly, we sought to tune the affinity of a high-affinity FAP binding domain in the context of the 2+1 Fab2-scFv-Fc bsAb format.

6A: Affinity De-Maturation Library

We first generated an affinity de-maturation library for a high-affinity FAP binding domain as His-tagged Fab fragments, illustrative sequences for which are depicted in FIG. 45. The affinity of the variants were investigated using Octet as generally described above. In particular, AHC biosensor was used to capture HIS-Avi-Fc-huFAP (sequences for which are depicted in FIG. 46) and dipped into multiple concentrations of each of the anti-FAP Fab variants. Kinetic analyses were performed by global fitting of binding data with a 1:1 Langmuir binding model. The resulting dissociation constant ($K_D$), association rate ($k_a$), and dissociation rate ($k_d$) are depicted in FIGS. 47-50 (respectively for each of 4 separate experiments). The data show that we obtained anti-FAP binding domains with a wide range of affinities.

6B: RTCC by Anti-FAP×Anti-CD3 bsAbs in the 2+1 Fab2-scFv-Fc Format with Affinity De-Matured FAP Binding Domains To investigate the effect of using affinity de-matured anti-FAP binding domains, illustrative anti-FAP×anti-CD3 bsAbs in the 2+1 Fab2-scFv-Fc format comprising binding domains as described in Example 6A were engineered and produced as generally described above, sequences for which are depicted in FIG. 51, and compared in vitro for RTCC on various cell lines as generally described above in Example 2C(b).

BJ human fibroblast (high FAP expression) and WI38 (low FAP expression) were incubated with human PBMCs and the indicated test articles overnight at 37° C. at an effector:target ratio of 10:1. RTCC was determined using CytoTox-ONE™ Homogeneous Membrane Integrity Assay (Promega, Madison, Wis.) to measure lactate dehydrogenase levels according to manufacturer's instructions and data was acquired on a Wallac Victor2 Microplate Reader (PerkinElmer, Waltham, Mass.).

The data depicted in FIG. 52 show that anti-FAP×anti-CD3 bsAbs in the 2+1 Fab2-scFv-Fc format comprising FAP binding arms with higher affinity arms (e.g. XENP28114) was more potent on $FAP^{low}$ cell lines than bsAbs comprising substantially affinity de-matured FAP binding arms (e.g. XENP28115), while bsAbs comprising substantially affinity de-matured FAP binding arms induce negligible RTCC on $FAP^{low}$ cells lines compared to in $FAP^{high}$ cell lines. This indicates that tuning the affinity of the FAP binding in anti-FAP×anti-CD3 bsAbs in the 2+1 Fab2-scFv-Fc format provides selectivity towards cells with various densities of FAP expression.

6C: T Cell Activation and Cytokine Release by Anti-FAP× Anti-CD3 bsAbs in the 2+1 Fab2-scFv-Fc Format with Affinity De-Matured FAP Binding Domains We further investigated the activation of T cells and cytokine release by the above described anti-FAP×anti-CD3 bsAbs. CD69 is an early activation marker, and CD25 is a late activation marker, both of which are upregulated following T cell activation via TCR signaling. CD107a is a functional marker for T cell degranulation and cytotoxic activity. Cytokine release syndrome refers to the excess release of cytokines such as IFNγ, TNFα, and IL-6 from PBMCs, and may cause life-threatening reactions in patients.

BJ human fibroblasts were incubated with human PBMCs at an effector:target ratio of 10:1, various concentrations of the indicated test articles, and anti-CD107a-BV321 at 37° C. for 24 hours. After incubation, supernatant was collected for cytokine analysis by V-PLEX Proinflammatory Panel 1 Human Kit (according to manufacturer protocol; Meso Scale Discovery, Rockville, Md.). Cells were then washed and stained with anti-CD4-APC-Cy7, anti-CD8-PerCP-Cy5.5, anti-CD69-APC, and anti-CD25-PE-Cy7 staining antibodies, and analyzed by flow cytometry. Effector cells were gated to identify CD4$^+$ and CD8$^+$ T cells. T cells were then gated for CD69, CD25, and CD107a expression. Data depicting the upregulation of the markers on CD4$^+$ and CD8$^+$ T cells are depicted in FIGS. 53-56, and data depicting the release of IFNγ, TNFα, and IL-6 by PBMCs are depicted in FIG. 57. The data show that bsAbs having lower affinity FAP-binding arms (for example, XENP28393, XENP28115, and XENP28116) were less potent in activating T cells than bsAbs having higher affinity FAP-binding arms (for example, XENP28114). However, and notably, the bsAbs having lower affinity FAP-binding arms induced reduced cytokine release in comparison to bsAbs having higher affinity FAP-binding arms.

Example 7: Activity of Anti-FAP×Anti-CD3 in the Presence of Soluble FAP

Not only is FAP expressed on the cell-surface, but it is also shed into circulation in a soluble form. Accordingly, it is possible for soluble FAP in circulation to act as an antigen-sink and impact the activity of anti-FAP×anti-CD3 bispecifics. Accordingly, we investigated the activity of the anti-FAP×anti-CD3 bsAbs in the presence of soluble FAP (in-house produced as XENP24370; sequences for which are depicted in FIG. 58).

7A: bsAbs in 1+1 Fab-scFv-Fc Format are More Sensitive to Soluble FAP

Human plma from 2 separate donors or cyno plasma were incubated with various concentrations of the indicated test articles at room temperature for 1.5 hours. Following incubation, FAP concentration in samples were assessed using Human FAP DuoSet ELISA (R&D Systems, Minneapolis, Minn.), data for which are depicted in FIG. 59. The data show that in both human and cynomolgus plasma, FAP concentration dose-dependently decreased with XENP23535 (anti-FAP×anti-CD3 in 1+1 Fab-scFv-Fc format), while FAP concentration was less impacted by the anti-FAP×anti-CD3 bsAbs in 2+1 Fab2-scFv-Fc format. This indicates that in a clinical setting, anti-FAP×anti-CD3 bsAbs in the 1+1 Fab-scFv-Fc format may be more subject to antigen sink and impact the pharmacokinetics and/or pharmacodynamics of the bsAbs.

7B: bsAbs in 1+1 Fab-scFv-Fc Format are More Sensitive to Soluble FAP

BJ human fibroblast (high FAP expression) cells were incubated with human PBMCs and the indicated test articles at 37° C. for 24 hours at an effector:target ratio of 10:1 with or without 100 ng/ml soluble FAP. RTCC was determined using CytoTox-ONE™ Homogeneous Membrane Integrity Assay (Promega, Madison, Wis.) to measure lactate dehydrogenase levels according to manufacturer's instructions and data was acquired on a Wallac Victor2 Microplate Reader (PerkinElmer, Waltham, Mass.).

The data depicted in FIGS. 60 and 61 show that soluble FAP decreased the potency of several of the test articles. In particular, bsAbs such as XENP28114 which has a high affinity FAP-binding arm demonstrated the greatest decrease in potency in the presence of soluble FAP. Notably, the potency of bsAbs such as XENP25194, XENP25195, XENP25967, XENP28115, and XENP28116 which had lower affinity FAP-binding arms were less impacted by the presence of soluble FAP.

Example 8: Generation of Anti-FAP×Anti-CD3 bsAbs with Xtend

We also generated the anti-FAP×anti-CD3 bsAbs with Fc regions comprising the Xtend (M428L/N434S) mutations as enhanced serum half-life may be beneficial in a clinical setting. Sequences for illustrative such bsAbs are depicted in FIG. 62, and antibodies were produced as generally described in Example 2A.

SEQUENCE LISTING (1179 sequences)

SEQ ID NO: 1 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 2 - protein, 761 aa, Mus musculus
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 3 - protein, 760 aa, Macaca fascicularis
MKTWVKIVFGVATSAVLALLVMCIVLRPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 4 - protein, 20 aa, Artificial Sequence
  Description of Artificial Sequence: Synthetic peptide
GKPGSGKPGSGKPGSGKPGS

SEQ ID NO: 5 - protein, 15 aa, Artificial Sequence
  Description of Artificial Sequence: Synthetic peptide
GGGGSGGGGSGGGGS

SEQ ID NO: 6 - protein, 18 aa, Artificial Sequence
  Description of Artificial Sequence: Synthetic peptide
GSTSGSGKPGSGEGSTKG

SEQ ID NO: 7 - protein, 14 aa, Artificial Sequence
  Description of Artificial Sequence: Synthetic peptide
IRPRAIGGSKPRVA

SEQ ID NO: 8 - protein, 15 aa, Artificial Sequence
  Description of Artificial Sequence: Synthetic peptide
GKGGSGKGGSGKGGS

SEQ ID NO: 9 - protein, 15 aa, Artificial Sequence
  Description of Artificial Sequence: Synthetic peptide
GGKGSGGKGSGGKGS

SEQ ID NO: 10 - protein, 15 aa, Artificial Sequence
  Description of Artificial Sequence: Synthetic peptide
GGGKSGGGKSGGGKS

SEQ ID NO: 11 - protein, 15 aa, Artificial Sequence
  Description of Artificial Sequence: Synthetic peptide
GKGKSGKGKSGKGKS

SEQ ID NO: 12 - protein, 15 aa, Artificial Sequence
  Description of Artificial Sequence: Synthetic peptide
GGGKSGGKGSGKGGS

SEQ ID NO: 13 - protein, 15 aa, Artificial Sequence
  Description of Artificial Sequence: Synthetic peptide
GKPGSGKPGSGKPGS

SEQ ID NO: 14 - protein, 20 aa, Artificial Sequence
  Description of Artificial Sequence: Synthetic peptide
GKGKSGKGKSGKGKSGKGKS

SEQ ID NO: 15 - protein, 20 aa, Artificial Sequence
  Description of Artificial Sequence: Synthetic peptide
GGGGSGGGGSGGGGSGGGGS

SEQ ID NO: 16 - protein, 14 aa, Artificial Sequence
  Description of Artificial Sequence: Synthetic peptide
STAGDTHLGGEDFD

SEQ ID NO: 17 - protein, 15 aa, Artificial Sequence
  Description of Artificial Sequence: Synthetic peptide
GEGGSGEGGSGEGGS

SEQ ID NO: 18 - protein, 15 aa, Artificial Sequence
  Description of Artificial Sequence: Synthetic peptide
GGEGSGGEGSGGEGS

SEQ ID NO: 19 - protein, 15 aa, Artificial Sequence
  Description of Artificial Sequence: Synthetic peptide
GGGESGGGESGGGES

SEQ ID NO: 20 - protein, 15 aa, Artificial Sequence
  Description of Artificial Sequence: Synthetic peptide
GEGESGEGESGEGES

SEQ ID NO: 21 - protein, 15 aa, Artificial Sequence
  Description of Artificial Sequence: Synthetic peptide
GGGESGGEGSGEGGS

SEQ ID NO: 22 - protein, 20 aa, Artificial Sequence
  Description of Artificial Sequence: Synthetic peptide
GEGESGEGESGEGESGEGES

SEQ ID NO: 23 - protein, 19 aa, Artificial Sequence
  Description of Artificial Sequence: Synthetic peptide
PRGASKSGSASQTGSAPGS

SEQ ID NO: 24 - protein, 19 aa, Artificial Sequence
  Description of Artificial Sequence: Synthetic peptide
GTAAAGAGAAGGAAAGAAG

SEQ ID NO: 25 - protein, 19 aa, Artificial Sequence
  Description of Artificial Sequence: Synthetic peptide
GTSGSSGSGSGGSGSGGGG

SEQ ID NO: 26 - protein, 9 aa, Artificial Sequence
  Description of Artificial Sequence: Synthetic peptide
KTHTCPPCP

SEQ ID NO: 27 - protein, 15 aa, Artificial Sequence
  Description of Artificial Sequence: Synthetic peptide
EPKSSDKTHTCPPCP

SEQ ID NO: 28 - protein, 19 aa, Artificial Sequence
  Description of Artificial Sequence: Synthetic peptide
GGGGSGGGGSKTHTCPPCP

SEQ ID NO: 29 - protein, 19 aa, Artificial Sequence
  Description of Artificial Sequence: Synthetic peptide
GKPGSGKPGSKTHTCPPCP

SEQ ID NO: 30 - protein, 14 aa, Artificial Sequence
  Description of Artificial Sequence: Synthetic peptide
GKPGSKTHTCPPCP

SEQ ID NO: 31 - protein, 329 aa, Artificial Sequence
  Description of Artificial Sequence: Synthetic polypeptide
  1 + 1 Fab-scFv-Fc Backbone 1 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 32 - protein, 231 aa, Artificial Sequence
  Description of Artificial Sequence: Synthetic polypeptide
  1 + 1 Fab-scFv-Fc Backbone 1 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 329 aa, Artificial Sequence; identical to SEQ ID NO: 31
  Description of Artificial Sequence: Synthetic polypeptide
  1 + 1 Fab-scFv-Fc Backbone 2 Fab-Fc Side

SEQ ID NO: 34 - protein, 231 aa, Artificial Sequence
  Description of Artificial Sequence: Synthetic polypeptide
  1 + 1 Fab-scFv-Fc Backbone 2 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 329 aa, Artificial Sequence
  Description of Artificial Sequence: Synthetic polypeptide
  1 + 1 Fab-scFv-Fc Backbone 3 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 36 - protein, 231 aa, Artificial Sequence; identical to SEQ ID NO: 34
  Description of Artificial Sequence: Synthetic polypeptide
  1 + 1 Fab-scFv-Fc Backbone 3 scFv-Fc Side

SEQ ID NO: 37 - protein, 329 aa, Artificial Sequence
  Description of Artificial Sequence: Synthetic polypeptide
  1 + 1 Fab-scFv-Fc Backbone 4 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 38 - protein, 231 aa, Artificial Sequence
  Description of Artificial Sequence: Synthetic polypeptide
  1 + 1 Fab-scFv-Fc Backbone 4 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 39 - protein, 329 aa, Artificial Sequence
  Description of Artificial Sequence: Synthetic polypeptide
  1 + 1 Fab-scFv-Fc Backbone 5 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 40 - protein, 231 aa, Artificial Sequence
  Description of Artificial Sequence: Synthetic polypeptide
  1 + 1 Fab-scFv-Fc Backbone 5 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 329 aa, Artificial Sequence
  Description of Artificial Sequence: Synthetic polypeptide
  1 + 1 Fab-scFv-Fc Backbone 6 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 42 - protein, 231 aa, Artificial Sequence
  Description of Artificial Sequence: Synthetic polypeptide
  1 + 1 Fab-scFv-Fc Backbone 6 scFv-Fc Side
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 329 aa, Artificial Sequence
  Description of Artificial Sequence: Synthetic polypeptide
  1 + 1 Fab-scFv-Fc Backbone 7 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 44 - protein, 231 aa, Artificial Sequence
  Description of Artificial Sequence: Synthetic polypeptide
  1 + 1 Fab-scFv-Fc Backbone 7 scFv-Fc Side
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 327 aa, Artificial Sequence
  Description of Artificial Sequence: Synthetic polypeptide
  1 + 1 Fab-scFv-Fc Backbone 8 Fab-Fc Side
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 46 - protein, 229 aa, Artificial Sequence
  Description of Artificial Sequence: Synthetic polypeptide
  1 + 1 Fab-scFv-Fc Backbone 8 scFv-Fc Side
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 47 - protein, 326 aa, Artificial Sequence
  Description of Artificial Sequence: Synthetic polypeptide
  1 + 1 Fab-scFv-Fc Backbone 9 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 48 - protein, 228 aa, Artificial Sequence
  Description of Artificial Sequence: Synthetic polypeptide
  1 + 1 Fab-scFv-Fc Backbone 9 scFv-Fc Side
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 49 - protein, 326 aa, Artificial Sequence
  Description of Artificial Sequence: Synthetic polypeptide
  1 + 1 Fab-scFv-Fc Backbone 10 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 50 - protein, 228 aa, Artificial Sequence
  Description of Artificial Sequence: Synthetic polypeptide
  1 + 1 Fab-scFv-Fc Backbone 10 scFv-Fc Side
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 51 - protein, 329 aa, Artificial Sequence
  Description of Artificial Sequence: Synthetic polypeptide
  1 + 1 Fab-scFv-Fc Backbone 11 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 52 - protein, 231 aa, Artificial Sequence
  Description of Artificial Sequence: Synthetic polypeptide
  1 + 1 Fab-scFv-Fc Backbone 11 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 53 - protein, 329 aa, Artificial Sequence
  Description of Artificial Sequence: Synthetic polypeptide
  1 + 1 Fab-scFv-Fc Backbone 12 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVAGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 231 aa, Artificial Sequence
  Description of Artificial Sequence: Synthetic polypeptide
  1 + 1 Fab-scFv-Fc Backbone 12 scFv-Fc Side
ERKSSDKTHTCPPRPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 329 aa, Artificial Sequence; identical to SEQ ID NO: 31
  Description of Artificial Sequence: Synthetic polypeptide
  2 + 1 Fab2-scFv-Fc Backbone 1 Fab-Fc Side

SEQ ID NO: 56 - protein, 216 aa, Artificial Sequence
  Description of Artificial Sequence: Synthetic polypeptide
  2 + 1 Fab2-scFv-Fc Backbone 1 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 329 aa, Artificial Sequence; identical to SEQ ID NO: 31
  Description of Artificial Sequence: Synthetic polypeptide
  2 + 1 Fab2-scFv-Fc Backbone 2 Fab-Fc Side

SEQ ID NO: 58 - protein, 216 aa, Artificial Sequence
  Description of Artificial Sequence: Synthetic polypeptide
  2 + 1 Fab2-scFv-Fc Backbone 2 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 329 aa, Artificial Sequence; identical to SEQ ID NO: 35
  Description of Artificial Sequence: Synthetic polypeptide
  2 + 1 Fab2-scFv-Fc Backbone 3 Fab-Fc Side

SEQ ID NO: 60 - protein, 216 aa, Artificial Sequence; identical to SEQ ID NO: 58
  Description of Artificial Sequence: Synthetic polypeptide
  2 + 1 Fab2-scFv-Fc Backbone 3 Fab-scFv-Fc Side

SEQ ID NO: 61 - protein, 329 aa, Artificial Sequence; identical to SEQ ID NO: 37
  Description of Artificial Sequence: Synthetic polypeptide
  2 + 1 Fab2-scFv-Fc Backbone 4 Fab-Fc Side

SEQ ID NO: 62 - protein, 216 aa, Artificial Sequence
  Description of Artificial Sequence: Synthetic polypeptide
  2 + 1 Fab2-scFv-Fc Backbone 4 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 63 - protein, 329 aa, Artificial Sequence; identical to SEQ ID NO: 39
  Description of Artificial Sequence: Synthetic polypeptide
  2 + 1 Fab2-scFv-Fc Backbone 5 Fab-Fc Side

SEQ ID NO: 64 - protein, 216 aa, Artificial Sequence
  Description of Artificial Sequence: Synthetic polypeptide
  2 + 1 Fab2-scFv-Fc Backbone 5 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 329 aa, Artificial Sequence; identical to SEQ ID NO: 41
  Description of Artificial Sequence: Synthetic polypeptide
  2 + 1 Fab2-scFv-Fc Backbone 6 Fab-Fc Side

SEQ ID NO: 66 - protein, 216 aa, Artificial Sequence
  Description of Artificial Sequence: Synthetic polypeptide
  2 + 1 Fab2-scFv-Fc Backbone 6 Fab-scFv-Fc Side
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 329 aa, Artificial Sequence; identical to SEQ ID NO: 43
  Description of Artificial Sequence: Synthetic polypeptide
  2 + 1 Fab2-scFv-Fc Backbone 7 Fab-Fc Side

SEQ ID NO: 68 - protein, 216 aa, Artificial Sequence
  Description of Artificial Sequence: Synthetic polypeptide
  2 + 1 Fab2-scFv-Fc Backbone 7 Fab-scFv-Fc Side
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 329 aa, Artificial Sequence; identical to SEQ ID NO: 51
  Description of Artificial Sequence: Synthetic polypeptide
  2 + 1 Fab2-scFv-Fc Backbone 8 Fab-Fc Side

SEQ ID NO: 70 - protein, 216 aa, Artificial Sequence
  Description of Artificial Sequence: Synthetic polypeptide
  2 + 1 Fab2-scFv-Fc Backbone 8 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 71 - protein, 329 aa, Artificial Sequence; identical to SEQ ID NO: 53
  Description of Artificial Sequence: Synthetic polypeptide
  2 + 1 Fab2-scFv-Fc Backbone 9 Fab-Fc Side

SEQ ID NO: 72 - protein, 216 aa, Artificial Sequence
  Description of Artificial Sequence: Synthetic polypeptide
  2 + 1 Fab2-scFv-Fc Backbone 9 Fab-scFv-Fc Side
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 125 aa, Artificial Sequence
  Description of Artificial Sequence: Synthetic polypeptide
  High CD3:  Anti-CD3_H1.30_L1.47 Variable heavy (vh) domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 74 - protein, 107 aa, Artificial Sequence [sequence omitted]

SEQ ID NO: 75 - protein, 106 aa, Artificial Sequence
  Description of Artificial Sequence: Synthetic polypeptide
  Constant Light Chain -  Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 76 - protein, 5 aa, Artificial Sequence
  Description of Artificial Sequence: Synthetic peptide
  High CD3:  Anti-CD3_H1.30_L1.47 vhCDR1
TYAMN

SEQ ID NO: 77 - protein, 19 aa, Artificial Sequence
  Description of Artificial Sequence: Synthetic peptide
  High CD3:  Anti-CD3_H1.30_L1.47 vhCDR2
RIRSKYNNYATYYADSVKG

SEQ ID NO: 78 - protein, 14 aa, Artificial Sequence
  Description of Artificial Sequence: Synthetic peptide
  High CD3:  Anti-CD3_H1.30_L1.47 vhCDR3
HGNFGDSYVSWFAY

SEQ ID NO: 79 - protein, 109 aa, Artificial Sequence
  Description of Artificial Sequence: Synthetic polypeptide
  High CD3:  Anti-CD3_H1.30_L1.47 Variable light (vl) domain
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 80 - protein, 14 aa, Artificial Sequence
  Description of Artificial Sequence: Synthetic peptide
  High CD3:  Anti-CD3_H1.30_L1.47 vlCDR1
GSSTGAVTTSNYAN

SEQ ID NO: 81 - protein, 7 aa, Artificial Sequence
  Description of Artificial Sequence: Synthetic peptide
  High CD3:  Anti-CD3_H1.30_L1.47 vlCDR2
GTNKRAP

SEQ ID NO: 82 - protein, 9 aa, Artificial Sequence
  Description of Artificial Sequence: Synthetic peptide
  High CD3:  Anti-CD3_H1.30_L1.47 vlCDR3
ALWYSNHWV

SEQ ID NO: 83 - protein, 254 aa, Artificial Sequence
  Description of Artificial Sequence: Synthetic polypeptide
  High CD3:  Anti-CD3_H1.30_L1.47 scFv (VH-scFv linker-VL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 84 - protein, 254 aa, Artificial Sequence
  Description of Artificial Sequence: Synthetic polypeptide
  High CD3:  Anti-CD3_H1.30_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 85 - protein, 125 aa, Artificial Sequence
  Description of Artificial Sequence: Synthetic polypeptide
  High-Int #1 CD3: Anti-CD3_H1.32_L1.47 Variable heavy (vh) domain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 86 - protein, 5 aa, Artificial Sequence
  Description of Artificial Sequence: Synthetic peptide
  High-Int #1 CD3: Anti-CD3_H1.32_L1.47 vhCDR1
TYAMN

SEQ ID NO: 87 - protein, 19 aa, Artificial Sequence
  Description of Artificial Sequence: Synthetic peptide
  High-Int #1 CD3: Anti-CD3_H1.32_L1.47 vhCDR2
RIRSKANNYATYYADSVKG

SEQ ID NO: 88 - protein, 14 aa, Artificial Sequence
  Description of Artificial Sequence: Synthetic peptide
  High-Int #1 CD3: Anti-CD3_H1.32_L1.47 vhCDR3
HGNFGDSYVSWFAY

SEQ ID NO: 89 - protein, 109 aa, Artificial Sequence; identical to SEQ ID NO: 79
  Description of Artificial Sequence: Synthetic polypeptide
  High-Int #1 CD3: Anti-CD3_H1.32_L1.47 Variable light (vl) domain

SEQ ID NO: 90 - protein, 14 aa, Artificial Sequence
  Description of Artificial Sequence: Synthetic peptide
  High-Int #1 CD3: Anti-CD3_H1.32_L1.47 vlCDR1
GSSTGAVTTSNYAN

SEQ ID NO: 91 - protein, 7 aa, Artificial Sequence
  Description of Artificial Sequence: Synthetic peptide
  High-Int #1 CD3: Anti-CD3_H1.32_L1.47 vlCDR2
GTNKRAP

SEQ ID NO: 92 - protein, 9 aa, Artificial Sequence
  Description of Artificial Sequence: Synthetic peptide
  High-Int #1 CD3: Anti-CD3_H1.32_L1.47 vlCDR3
ALWYSNHWV

SEQ ID NO: 93 - protein, 254 aa, Artificial Sequence
  Description of Artificial Sequence: Synthetic polypeptide
  High-Int #1 CD3: Anti-CD3_H1.32_L1.47 scFv (VH-scFv linker-VL)
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 94 - protein, 254 aa, Artificial Sequence
  Description of Artificial Sequence: Synthetic polypeptide
  High-Int #1 CD3: Anti-CD3_H1.32_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 95 - protein, 125 aa, Artificial Sequence
  Description of Artificial Sequence: Synthetic polypeptide
  High-Int #2 CD3:  Anti-CD3_H1.89_L1.47 Variable heavy (vh) domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 96 - protein, 5 aa, Artificial Sequence
  Description of Artificial Sequence: Synthetic peptide
  High-Int #2 CD3:  Anti-CD3_H1.89_L1.47 vhCDR1
TYAMN

SEQ ID NO: 97 - protein, 19 aa, Artificial Sequence
  Description of Artificial Sequence: Synthetic peptide
  High-Int #2 CD3:  Anti-CD3_H1.89_L1.47 vhCDR2
RIRSKYNNYATYYADSVKG

SEQ ID NO: 98 - protein, 14 aa, Artificial Sequence
  Description of Artificial Sequence: Synthetic peptide
  High-Int #2 CD3:  Anti-CD3_H1.89_L1.47 vhCDR3
HGNFGDEYVSWFAY

SEQ ID NO: 99 - protein, 109 aa, Artificial Sequence; identical to SEQ ID NO: 79
  Description of Artificial Sequence: Synthetic polypeptide
  High-Int #2 CD3:  Anti-CD3_H1.89_L1.47 Variable light (vl) domain

SEQ ID NO: 100 - protein, 14 aa, Artificial Sequence
  Description of Artificial Sequence: Synthetic peptide
  High-Int #2 CD3:  Anti-CD3_H1.89_L1.47 vlCDR1
GSSTGAVTTSNYAN

SEQ ID NO: 101 - protein, 7 aa, Artificial Sequence
  Description of Artificial Sequence: Synthetic peptide
  High-Int #2 CD3:  Anti-CD3_H1.89_L1.47 vlCDR2
GTNKRAP

SEQ ID NO: 102 - protein, 9 aa, Artificial Sequence
  Description of Artificial Sequence: Synthetic peptide
  High-Int #2 CD3:  Anti-CD3_H1.89_L1.47 vlCDR3
ALWYSNHWV

SEQ ID NO: 103 - protein, 254 aa, Artificial Sequence
  Description of Artificial Sequence: Synthetic polypeptide
  High-Int #2 CD3:  Anti-CD3_H1.89_L1.47 scFv (VH-scFv linker-VL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 104 - protein, 254 aa, Artificial Sequence
  Description of Artificial Sequence: Synthetic polypeptide
  High-Int #2 CD3:  Anti-CD3_H1.89_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 105 - protein, 125 aa, Artificial Sequence
  Description of Artificial Sequence: Synthetic polypeptide
  High-Int #3 CD3:  Anti-CD3_H1.90_L1.47 Variable heavy (vh) domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 106 - protein, 5 aa, Artificial Sequence
  Description of Artificial Sequence: Synthetic peptide
  High-Int #3 CD3:  Anti-CD3_H1.90_L1.47 vhCDR1
TYAMN

SEQ ID NO: 107 - protein, 19 aa, Artificial Sequence
  Description of Artificial Sequence: Synthetic peptide
  High-Int #3 CD3:  Anti-CD3_H1.90_L1.47 vhCDR2
RIRSKYNNYATYYADSVKG

SEQ ID NO: 108 - protein, 14 aa, Artificial Sequence
  Description of Artificial Sequence: Synthetic peptide
  High-Int #3 CD3:  Anti-CD3_H1.90_L1.47 vhCDR3
HGNFGDPYVSWFAY

SEQ ID NO: 109 - protein, 109 aa, Artificial Sequence; identical to SEQ ID NO: 79
  Description of Artificial Sequence: Synthetic polypeptide
  High-Int #3 CD3:  Anti-CD3_H1.90_L1.47 Variable light (vl) domain

SEQ ID NO: 110 - protein, 14 aa, Artificial Sequence
  Description of Artificial Sequence: Synthetic peptide
  High-Int #3 CD3:  Anti-CD3_H1.90_L1.47 vlCDR1
GSSTGAVTTSNYAN

SEQ ID NO: 111 - protein, 7 aa, Artificial Sequence
  Description of Artificial Sequence: Synthetic peptide
  High-Int #3 CD3:  Anti-CD3_H1.90_L1.47 vlCDR2
GTNKRAP

SEQ ID NO: 112 - protein, 9 aa, Artificial Sequence
  Description of Artificial Sequence: Synthetic peptide
  High-Int #3 CD3:  Anti-CD3_H1.90_L1.47 vlCDR3
ALWYSNHWV

SEQ ID NO: 113 - protein, 254 aa, Artificial Sequence
  Description of Artificial Sequence: Synthetic polypeptide
  High-Int #3 CD3:  Anti-CD3_H1.90_L1.47 scFv (VH-scFv linker-VL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 114 - protein, 254 aa, Artificial Sequence
  Description of Artificial Sequence: Synthetic polypeptide
  High-Int #3 CD3:  Anti-CD3_H1.90_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 115 - protein, 125 aa, Artificial Sequence
  Description of Artificial Sequence: Synthetic polypeptide
  Intermediate CD3:  Anti-CD3_H1.33_L1.47 Variable heavy (vh) domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 116 - protein, 5 aa, Artificial Sequence
  Description of Artificial Sequence: Synthetic peptide
  Intermediate CD3:  Anti-CD3_H1.33_L1.47 vhCDR1
TYAMN

SEQ ID NO: 117 - protein, 19 aa, Artificial Sequence
  Description of Artificial Sequence: Synthetic peptide
  Intermediate CD3:  Anti-CD3_H1.33_L1.47 vhCDR2
RIRSKYNNYATYYADSVKG

SEQ ID NO: 118 - protein, 14 aa, Artificial Sequence
  Description of Artificial Sequence: Synthetic peptide
  Intermediate CD3:  Anti-CD3_H1.33_L1.47 vhCDR3
HGNFGDSYVSWFDY

SEQ ID NO: 119 - protein, 109 aa, Artificial Sequence; identical to SEQ ID NO: 79
  Description of Artificial Sequence: Synthetic polypeptide
  Intermediate CD3:  Anti-CD3_H1.33_L1.47 Variable light (vl) domain

SEQ ID NO: 120 - protein, 14 aa, Artificial Sequence
  Description of Artificial Sequence: Synthetic peptide
  Intermediate CD3:  Anti-CD3_H1.33_L1.47 vlCDR1
GSSTGAVTTSNYAN

SEQ ID NO: 121 - protein, 7 aa, Artificial Sequence
  Description of Artificial Sequence: Synthetic peptide
  Intermediate CD3:  Anti-CD3_H1.33_L1.47 vlCDR2
GTNKRAP

SEQ ID NO: 122 - protein, 9 aa, Artificial Sequence
  Description of Artificial Sequence: Synthetic peptide
  Intermediate CD3:  Anti-CD3_H1.33_L1.47 vlCDR3
ALWYSNHWV

SEQ ID NO: 123 - protein, 254 aa, Artificial Sequence
  Description of Artificial Sequence: Synthetic polypeptide
  Intermediate CD3:  Anti-CD3_H1.33_L1.47 scFv (VH-scFv linker-VL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 124 - protein, 254 aa, Artificial Sequence
  Description of Artificial Sequence: Synthetic polypeptide
  Intermediate CD3:  Anti-CD3_H1.33_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 125 - protein, 125 aa, Artificial Sequence
  Description of Artificial Sequence: Synthetic polypeptide
  Low CD3:  Anti-CD3_H1.31_L1.47 Variable heavy (vh) domain
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 126 - protein, 5 aa, Artificial Sequence
  Description of Artificial Sequence: Synthetic peptide
  Low CD3:  Anti-CD3_H1.31_L1.47 vhCDR1
TYAMS

SEQ ID NO: 127 - protein, 19 aa, Artificial Sequence
  Description of Artificial Sequence: Synthetic peptide
  Low CD3:  Anti-CD3_H1.31_L1.47 vhCDR2
RIRSKYNNYATYYADSVKG

SEQ ID NO: 128 - protein, 14 aa, Artificial Sequence
  Description of Artificial Sequence: Synthetic peptide
  Low CD3:  Anti-CD3_H1.31_L1.47 vhCDR3
HGNFGDSYVSWFAY

SEQ ID NO: 129 - protein, 109 aa, Artificial Sequence; identical to SEQ ID NO: 79
  Description of Artificial Sequence: Synthetic polypeptide
  Low CD3:  Anti-CD3_H1.31_L1.47 Variable light (vl) domain

SEQ ID NO: 130 - protein, 14 aa, Artificial Sequence
  Description of Artificial Sequence: Synthetic peptide
  Low CD3:  Anti-CD3_H1.31_L1.47 vlCDR1
GSSTGAVTTSNYAN

SEQ ID NO: 131 - protein, 7 aa, Artificial Sequence
  Description of Artificial Sequence: Synthetic peptide
  Low CD3:  Anti-CD3_H1.31_L1.47 vlCDR2
GTNKRAP

SEQ ID NO: 132 - protein, 9 aa, Artificial Sequence
  Description of Artificial Sequence: Synthetic peptide
  Low CD3:  Anti-CD3_H1.31_L1.47 vlCDR3
ALWYSNHWV

SEQ ID NO: 133 - protein, 254 aa, Artificial Sequence
  Description of Artificial Sequence: Synthetic polypeptide
  Low CD3:  Anti-CD3_H1.31_L1.47 scFv (VH-scFv linker-VL))
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 134 - protein, 254 aa, Artificial Sequence
  Description of Artificial Sequence: Synthetic polypeptide
  Low CD3:  Anti-CD3_H1.31_L1.47 scFv (VL-scFv linker-VH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 135 - protein, 453 aa, Artificial Sequence
  Description of Artificial Sequence: Synthetic polypeptide
  XENP023534 sibrotuzumab[FAP]_H0L0_IgG1_PVA_/S267K Heavy Chain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 220 aa, Artificial Sequence
  Description of Artificial Sequence: Synthetic polypeptide
  XENP023534 sibrotuzumab[FAP]_H0L0_IgG1_PVA_/S267K Light Chain
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 446 aa, Artificial Sequence
  Description of Artificial Sequence: Synthetic polypeptide
  XENP023929 29B11[FAP]_H0L0_IgG1_PVA_/S267K Heavy Chain
EVQLLESGGGLVQPGGSLRLSCAASGFTFSSYAMSWVRQAPGKGLEWVSAIIGSGGITYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 215 aa, Artificial Sequence
  Description of Artificial Sequence: Synthetic polypeptide
  XENP023929 29B11[FAP]_H0L0_IgG1_PVA_/S267K Light Chain
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 446 aa, Artificial Sequence
  Description of Artificial Sequence: Synthetic polypeptide
  XENP023933 3F2[FAP]_H0L0_IgG1_PVA_/S267K Heavy Chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 215 aa, Artificial Sequence; identical to SEQ ID NO: 138
  Description of Artificial Sequence: Synthetic polypeptide
  XENP023933 3F2[FAP]_H0L0_IgG1_PVA_/S267K Light Chain

SEQ ID NO: 141 - protein, 118 aa, Artificial Sequence
  Description of Artificial Sequence: Synthetic polypeptide
  1A4A5[FAP]_H1L1_ Variable heavy (vh) domain
EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKDAGRPYFDYWGQGTLVTVSS

SEQ ID NO: 142 - protein, 5 aa, Artificial Sequence
  Description of Artificial Sequence: Synthetic peptide
  1A4A5[FAP]_H1L1_ vhCDR1
SYAMS

SEQ ID NO: 143 - protein, 17 aa, Artificial Sequence
  Description of Artificial Sequence: Synthetic peptide
  1A4A5[FAP]_H1L1_ vhCDR2
AISGSGGTTYYADSVKG

SEQ ID NO: 144 - protein, 8 aa, Artificial Sequence
  Description of Artificial Sequence: Synthetic peptide
  1A4A5[FAP]_H1L1_ vhCDR3
DAGRPYFD

SEQ ID NO: 145 - protein, 106 aa, Artificial Sequence
  Description of Artificial Sequence: Synthetic polypeptide
  1A4A5[FAP]_H1L1_ Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYKFPYTFGQGTKLEI

SEQ ID NO: 146 - protein, 11 aa, Artificial Sequence
  Description of Artificial Sequence: Synthetic peptide
  1A4A5[FAP]_H1L1_ vlCDR1
RASQSISSYLN

SEQ ID NO: 147 - protein, 7 aa, Artificial Sequence
  Description of Artificial Sequence: Synthetic peptide
  1A4A5[FAP]_H1L1_ vlCDR2
AASSLQS

SEQ ID NO: 148 - protein, 9 aa, Artificial Sequence
  Description of Artificial Sequence: Synthetic peptide
  1A4A5[FAP]_H1L1_ vlCDR3
QQSYKFPYT

SEQ ID NO: 149 - protein, 120 aa, Artificial Sequence
  Description of Artificial Sequence: Synthetic polypeptide
  1C3A5[FAP]_H1L1 Variable heavy (vh) domain
EVQLLESGGGLVQPGGSLRLSCAASGFTFSSYAMSWVRQAPGKGLEWVSAISGSGGGTRYADSVKGRFTISRDNSKNTLYLQMNSLRAEDTAVYYCAKHSSGFHWYFDYWGQGTLVTVSS

SEQ ID NO: 150 - protein, 5 aa, Artificial Sequence
  Description of Artificial Sequence: Synthetic peptide
  1C3A5[FAP]_H1L1 vhCDR1
SYAMS

SEQ ID NO: 151 - protein, 17 aa, Artificial Sequence
  Description of Artificial Sequence: Synthetic peptide
  1C3A5[FAP]_H1L1 vhCDR2
AISGSGGGTRYADSVKG

SEQ ID NO: 152 - protein, 11 aa, Artificial Sequence
  Description of Artificial Sequence: Synthetic peptide
  1C3A5[FAP]_H1L1 vhCDR3
HSSGFHWYFDY

SEQ ID NO: 153 - protein, 107 aa, Artificial Sequence
  Description of Artificial Sequence: Synthetic polypeptide
  1C3A5[FAP]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIK

SEQ ID NO: 154 - protein, 10 aa, Artificial Sequence
  Description of Artificial Sequence: Synthetic peptide
  1C3A5[FAP]_H1L1 vlCDR1
RASQSISSYL

SEQ ID NO: 155 - protein, 7 aa, Artificial Sequence
  Description of Artificial Sequence: Synthetic peptide
  1C3A5[FAP]_H1L1 vlCDR2
AASSLQS

SEQ ID NO: 156 - protein, 9 aa, Artificial Sequence
  Description of Artificial Sequence: Synthetic peptide
  1C3A5[FAP]_H1L1 vlCDR3
QQSYSTPRT

SEQ ID NO: 157 - protein, 121 aa, Artificial Sequence
  Description of Artificial Sequence: Synthetic polypeptide
  1E5A5[FAP]_H1L1 Variable heavy (vh) domain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSS

SEQ ID NO: 158 - protein, 5 aa, Artificial Sequence
  Description of Artificial Sequence: Synthetic peptide
  1E5A5[FAP]_H1L1 vhCDR1
SYAMS

SEQ ID NO: 159 - protein, 17 aa, Artificial Sequence
  Description of Artificial Sequence: Synthetic peptide
  1E5A5[FAP]_H1L1 vhCDR2
GISGSGGSTYYADSVKG

SEQ ID NO: 160 - protein, 12 aa, Artificial Sequence
  Description of Artificial Sequence: Synthetic peptide
  1E5A5[FAP]_H1L1 vhCDR3
ISFYPGGTYFDY

SEQ ID NO: 161 - protein, 107 aa, Artificial Sequence
  Description of Artificial Sequence: Synthetic polypeptide
  1E5A5[FAP]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSSPYTFGQGTKLEIK

SEQ ID NO: 162 - protein, 11 aa, Artificial Sequence
  Description of Artificial Sequence: Synthetic peptide
  1E5A5[FAP]_H1L1 vlCDR1
RASQSISSYLN

SEQ ID NO: 163 - protein, 7 aa, Artificial Sequence
  Description of Artificial Sequence: Synthetic peptide
  1E5A5[FAP]_H1L1 vlCDR2
AASSLQS

SEQ ID NO: 164 - protein, 9 aa, Artificial Sequence
  Description of Artificial Sequence: Synthetic peptide
  1E5A5[FAP]_H1L1 vlCDR3
QQSYSSPYT

SEQ ID NO: 165 - protein, 121 aa, Artificial Sequence; identical to SEQ ID NO: 157
  Description of Artificial Sequence: Synthetic polypeptide
  1E5A5(COMMONLC)[FAP]_H1L1 Variable heavy (vh) domain

SEQ ID NO: 166 - protein, 5 aa, Artificial Sequence
  Description of Artificial Sequence: Synthetic peptide
  1E5A5(COMMONLC)[FAP]_H1L1 vhCDR1
SYAMS

SEQ ID NO: 167 - protein, 17 aa, Artificial Sequence
  Description of Artificial Sequence: Synthetic peptide
  1E5A5(COMMONLC)[FAP]_H1L1 vhCDR2
GISGSGGSTYYADSVKG

SEQ ID NO: 168 - protein, 12 aa, Artificial Sequence
  Description of Artificial Sequence: Synthetic peptide
  1E5A5(COMMONLC)[FAP]_H1L1 vhCDR3
ISFYPGGTYFDY

SEQ ID NO: 169 - protein, 107 aa, Artificial Sequence
  Description of Artificial Sequence: Synthetic polypeptide
  1E5A5(COMMONLC)[FAP]_H1L1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 170 - protein, 11 aa, Artificial Sequence
  Description of Artificial Sequence: Synthetic peptide
  1E5A5(COMMONLC)[FAP]_H1L1 vlCDR1
RASQSISSYLN

SEQ ID NO: 171 - protein, 7 aa, Artificial Sequence
  Description of Artificial Sequence: Synthetic peptide
  1E5A5(COMMONLC)[FAP]_H1L1 vlCDR2
AASSLQS

SEQ ID NO: 172 - protein, 9 aa, Artificial Sequence
  Description of Artificial Sequence: Synthetic peptide
  1E5A5(COMMONLC)[FAP]_H1L1 vlCDR3
QQSYSTPYT

SEQ ID NO: 173 - protein, 119 aa, Artificial Sequence
  Description of Artificial Sequence: Synthetic polypeptide
  1A1B5[FAP]_H1L1 Variable heavy (vh) domain
EVQLLESGGGLVQPGGSLRLSCAASGFTFSSYAMNWVRQAPGKGLEWVSTISSSGSRTYYADSVKGRFTISRDNSKNTLYLQMNSLRAEDTAVYYCAKGLVASAPFDYWGQGTLVTVSS

SEQ ID NO: 174 - protein, 5 aa, Artificial Sequence
  Description of Artificial Sequence: Synthetic peptide
  1A1B5[FAP]_H1L1 vhCDR1
SYAMN

SEQ ID NO: 175 - protein, 17 aa, Artificial Sequence
  Description of Artificial Sequence: Synthetic peptide
  1A1B5[FAP]_H1L1 vhCDR2
TISSSGSRTYYADSVKG

SEQ ID NO: 176 - protein, 9 aa, Artificial Sequence
  Description of Artificial Sequence: Synthetic peptide
  1A1B5[FAP]_H1L1 vhCDR3
GLVASAPFD

SEQ ID NO: 177 - protein, 107 aa, Artificial Sequence; identical to SEQ ID NO: 169
  Description of Artificial Sequence: Synthetic polypeptide
  1A1B5[FAP]_H1L1 Variable light (vl) domain

SEQ ID NO: 178 - protein, 11 aa, Artificial Sequence
  Description of Artificial Sequence: Synthetic peptide
  1A1B5[FAP]_H1L1 vlCDR1
RASQSISSYLN

SEQ ID NO: 179 - protein, 7 aa, Artificial Sequence
  Description of Artificial Sequence: Synthetic peptide
  1A1B5[FAP]_H1L1 vlCDR2
AASSLQS

SEQ ID NO: 180 - protein, 9 aa, Artificial Sequence
  Description of Artificial Sequence: Synthetic peptide
  1A1B5[FAP]_H1L1 vlCDR3
QQSYSTPYT

SEQ ID NO: 181 - protein, 121 aa, Artificial Sequence
  Description of Artificial Sequence: Synthetic polypeptide
  1A7B5[FAP]_H1L1 Variable heavy (vh) domain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSS

SEQ ID NO: 182 - protein, 5 aa, Artificial Sequence
  Description of Artificial Sequence: Synthetic peptide
  1A7B5[FAP]_H1L1 vhCDR1
SYAMS

SEQ ID NO: 183 - protein, 17 aa, Artificial Sequence
  Description of Artificial Sequence: Synthetic peptide
  1A7B5[FAP]_H1L1 vhCDR2
GISGGGGSTYYADSVKG

SEQ ID NO: 184 - protein, 12 aa, Artificial Sequence
  Description of Artificial Sequence: Synthetic peptide
  1A7B5[FAP]_H1L1 vhCDR3
IAHSRIGWHFDY

SEQ ID NO: 185 - protein, 107 aa, Artificial Sequence; identical to SEQ ID NO: 169
  Description of Artificial Sequence: Synthetic polypeptide
  1A7B5[FAP]_H1L1 Variable light (vl) domain

SEQ ID NO: 186 - protein, 11 aa, Artificial Sequence
  Description of Artificial Sequence: Synthetic peptide
  1A7B5[FAP]_H1L1 vlCDR1
RASQSISSYLN

SEQ ID NO: 187 - protein, 7 aa, Artificial Sequence
  Description of Artificial Sequence: Synthetic peptide
  1A7B5[FAP]_H1L1 vlCDR2
AASSLQS

SEQ ID NO: 188 - protein, 9 aa, Artificial Sequence
  Description of Artificial Sequence: Synthetic peptide
  1A7B5[FAP]_H1L1 vlCDR3
QQSYSTPYT

SEQ ID NO: 189 - protein, 121 aa, Artificial Sequence
  Description of Artificial Sequence: Synthetic polypeptide
  1F4B5[FAP]_H1L1 Variable heavy (vh) domain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSS

SEQ ID NO: 190 - protein, 4 aa, Artificial Sequence
  Description of Artificial Sequence: Synthetic peptide
  1F4B5[FAP]_H1L1 vhCDR1
RYAM

SEQ ID NO: 191 - protein, 17 aa, Artificial Sequence
  Description of Artificial Sequence: Synthetic peptide
  1F4B5[FAP]_H1L1 vhCDR2
SISASGGSTYYADSVKG

SEQ ID NO: 192 - protein, 12 aa, Artificial Sequence
  Description of Artificial Sequence: Synthetic peptide
  1F4B5[FAP]_H1L1 vhCDR3
TFSGYAHYDFDY

SEQ ID NO: 193 - protein, 107 aa, Artificial Sequence; identical to SEQ ID NO: 169
  Description of Artificial Sequence: Synthetic polypeptide
  1F4B5[FAP]_H1L1 Variable light (vl) domain

SEQ ID NO: 194 - protein, 11 aa, Artificial Sequence
  Description of Artificial Sequence: Synthetic peptide
  1F4B5[FAP]_H1L1 vlCDR1
RASQSISSYLN

SEQ ID NO: 195 - protein, 7 aa, Artificial Sequence
  Description of Artificial Sequence: Synthetic peptide
  1F4B5[FAP]_H1L1 vlCDR2
AASSLQS

SEQ ID NO: 196 - protein, 9 aa, Artificial Sequence
  Description of Artificial Sequence: Synthetic peptide
  1F4B5[FAP]_H1L1 vlCDR3
QQSYSTPYT

SEQ ID NO: 197 - protein, 121 aa, Artificial Sequence
  Description of Artificial Sequence: Synthetic polypeptide
  1F11B5[FAP]_H1L1 Variable heavy (vh) domain
EVQLLESGGGLVQPGGSLRLSCAASGFTFSSYAMNWVRQAPGKGLEWVSGISGGGSSTTYYADSVKGRFTISRDNSKNTLYLQMNSLRAEDTAVYYCAKPYYWVDSFFDYWGQGTLVTVSS

SEQ ID NO: 198 - protein, 5 aa, Artificial Sequence
  Description of Artificial Sequence: Synthetic peptide
  1F11B5[FAP]_H1L1 vhCDR1
SYAMN

SEQ ID NO: 199 - protein, 18 aa, Artificial Sequence
  Description of Artificial Sequence: Synthetic peptide
  1F11B5[FAP]_H1L1 vhCDR2
GISGGGSSTTYYADSVKG

SEQ ID NO: 200 - protein, 11 aa, Artificial Sequence
  Description of Artificial Sequence: Synthetic peptide
  1F11B5[FAP]_H1L1 vhCDR3
PYYWVDSFFDY

SEQ ID NO: 201 - protein, 107 aa, Artificial Sequence; identical to SEQ ID NO: 169
  Description of Artificial Sequence: Synthetic polypeptide
  1F11B5[FAP]_H1L1 Variable light (vl) domain

SEQ ID NO: 202 - protein, 11 aa, Artificial Sequence
  Description of Artificial Sequence: Synthetic peptide
  1F11B5[FAP]_H1L1 vlCDR1
RASQSISSYLN

SEQ ID NO: 203 - protein, 7 aa, Artificial Sequence
  Description of Artificial Sequence: Synthetic peptide
  1F11B5[FAP]_H1L1 vlCDR2
AASSLQS

SEQ ID NO: 204 - protein, 9 aa, Artificial Sequence
  Description of Artificial Sequence: Synthetic peptide
  1F11B5[FAP]_H1L1 vlCDR3
QQSYSTPYT

SEQ ID NO: 205 - protein, 121 aa, Artificial Sequence
  Description of Artificial Sequence: Synthetic polypeptide
  1F12B5[FAP]_H1L1 Variable heavy (vh) domain
EVQLLESGGGLVQPGGSLRLSCAASGFTFSSYAMTWVRQAPGKGLEWVSTISSSGGTTYYADSVKGRFTISRDNSKNTLYLQMNSLRAEDTAVYYCAKYPSYYSVTGFDYWGQGTLVTVSS

SEQ ID NO: 206 - protein, 5 aa, Artificial Sequence
  Description of Artificial Sequence: Synthetic peptide
  1F12B5[FAP]_H1L1 vhCDR1
SYAMT

SEQ ID NO: 207 - protein, 17 aa, Artificial Sequence
  Description of Artificial Sequence: Synthetic peptide
  1F12B5[FAP]_H1L1 vhCDR2
TISSSGGTTYYADSVKG

SEQ ID NO: 208 - protein, 12 aa, Artificial Sequence
  Description of Artificial Sequence: Synthetic peptide
  1F12B5[FAP]_H1L1 vhCDR3
YPSYYSVTGFDY

SEQ ID NO: 209 - protein, 107 aa, Artificial Sequence; identical to SEQ ID NO: 169
  Description of Artificial Sequence: Synthetic polypeptide
  1F12B5[FAP]_H1L1 Variable light (vl) domain

SEQ ID NO: 210 - protein, 11 aa, Artificial Sequence
  Description of Artificial Sequence: Synthetic peptide
  1F12B5[FAP]_H1L1 vlCDR1
RASQSISSYLN

SEQ ID NO: 211 - protein, 7 aa, Artificial Sequence
  Description of Artificial Sequence: Synthetic peptide
  1F12B5[FAP]_H1L1 vlCDR2
AASSLQS

SEQ ID NO: 212 - protein, 9 aa, Artificial Sequence
  Description of Artificial Sequence: Synthetic peptide
  1F12B5[FAP]_H1L1 vlCDR3
QQSYSTPYT

SEQ ID NO: 213 - protein, 121 aa, Artificial Sequence
  Description of Artificial Sequence: Synthetic polypeptide
  1D5B5[FAP]_H1L1 Variable heavy (vh) domain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKVGFFGLSWGFDYWGQGTLVTVSS

SEQ ID NO: 214 - protein, 5 aa, Artificial Sequence
  Description of Artificial Sequence: Synthetic peptide
  1D5B5[FAP]_H1L1 vhCDR1
SYAMS

SEQ ID NO: 215 - protein, 17 aa, Artificial Sequence
  Description of Artificial Sequence: Synthetic peptide
  1D5B5[FAP]_H1L1 vhCDR2
GISGSGGSTYYADSVKG

SEQ ID NO: 216 - protein, 12 aa, Artificial Sequence
  Description of Artificial Sequence: Synthetic peptide
  1D5B5[FAP]_H1L1 vhCDR3
VGFFGLSWGFDY

SEQ ID NO: 217 - protein, 107 aa, Artificial Sequence; identical to SEQ ID NO: 169
  Description of Artificial Sequence: Synthetic polypeptide
  1D5B5[FAP]_H1L1 Variable light (vl) domain

SEQ ID NO: 218 - protein, 11 aa, Artificial Sequence
  Description of Artificial Sequence: Synthetic peptide
  1D5B5[FAP]_H1L1 vlCDR1
RASQSISSYLN

SEQ ID NO: 219 - protein, 7 aa, Artificial Sequence
  Description of Artificial Sequence: Synthetic peptide
  1D5B5[FAP]_H1L1 vlCDR2
AASSLQS

SEQ ID NO: 220 - protein, 9 aa, Artificial Sequence
  Description of Artificial Sequence: Synthetic peptide
  1D5B5[FAP]_H1L1 vlCDR3
QQSYSTPYT

SEQ ID NO: 221 - protein, 119 aa, Artificial Sequence
  Description of Artificial Sequence: Synthetic polypeptide
  1F10B5[FAP]_H1L1 Variable heavy (vh) domain
EVQLLESGGGLVQPGGSLRLSCAASGFTFSSYGMSWVRQAPGKGLEWVSGISGSGSSTHYADSVKGRFTISRDNSKNTLYLQMNSLRAEDTAVYYCAKGTTGLSYFDYWGQGTLVTVSS

SEQ ID NO: 222 - protein, 5 aa, Artificial Sequence
  Description of Artificial Sequence: Synthetic peptide
  1F10B5[FAP]_H1L1 vhCDR1
SYGMS

SEQ ID NO: 223 - protein, 17 aa, Artificial Sequence
  Description of Artificial Sequence: Synthetic peptide
  1F10B5[FAP]_H1L1 vhCDR2
GISGSGSSTHYADSVKG

SEQ ID NO: 224 - protein, 9 aa, Artificial Sequence
  Description of Artificial Sequence: Synthetic peptide
  1F10B5[FAP]_H1L1 vhCDR3
GTTGLSYFD

SEQ ID NO: 225 - protein, 107 aa, Artificial Sequence; identical to SEQ ID NO: 169
  Description of Artificial Sequence: Synthetic polypeptide
  1F10B5[FAP]_H1L1 Variable light (vl) domain

SEQ ID NO: 226 - protein, 11 aa, Artificial Sequence
  Description of Artificial Sequence: Synthetic peptide
  1F10B5[FAP]_H1L1 vlCDR1
RASQSISSYLN

SEQ ID NO: 227 - protein, 7 aa, Artificial Sequence
  Description of Artificial Sequence: Synthetic peptide
  1F10B5[FAP]_H1L1 vlCDR2
AASSLQS

SEQ ID NO: 228 - protein, 9 aa, Artificial Sequence
  Description of Artificial Sequence: Synthetic peptide
  1F10B5[FAP]_H1L1 vlCDR3
QQSYSTPYT

SEQ ID NO: 229 - protein, 124 aa, Artificial Sequence
  Description of Artificial Sequence: Synthetic polypeptide
  [alphaFAP]_H0.26L0 Variable heavy (vh) domain
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSS

SEQ ID NO: 230 - protein, 5 aa, Artificial Sequence
  Description of Artificial Sequence: Synthetic peptide
  [alphaFAP]_H0.26L0 vhCDR1
EYSIH

SEQ ID NO: 231 - protein, 17 aa, Artificial Sequence
  Description of Artificial Sequence: Synthetic peptide
  [alphaFAP]_H0.26L0 vhCDR2
GINPNTGIPNYNQKFKG

SEQ ID NO: 232 - protein, 15 aa, Artificial Sequence
  Description of Artificial Sequence: Synthetic peptide
  [alphaFAP]_H0.26L0 vhCDR3
RRIAYGYDEGHAMDY

SEQ ID NO: 233 - protein, 113 aa, Artificial Sequence
  Description of Artificial Sequence: Synthetic polypeptide
  [alphaFAP]_H0.26L0 Variable light (vl) domain
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 234 - protein, 17 aa, Artificial Sequence
  Description of Artificial Sequence: Synthetic peptide
  [alphaFAP]_H0.26L0 vlCDR1
KSSQSLLYSRNQKNYLA

SEQ ID NO: 235 - protein, 7 aa, Artificial Sequence
  Description of Artificial Sequence: Synthetic peptide
  [alphaFAP]_H0.26L0 vlCDR2
WASTRES

SEQ ID NO: 236 - protein, 9 aa, Artificial Sequence
  Description of Artificial Sequence: Synthetic peptide
  [alphaFAP]_H0.26L0 vlCDR3
QQYFSYPLT

SEQ ID NO: 237 - protein, 124 aa, Artificial Sequence; identical to SEQ ID NO: 229
  Description of Artificial Sequence: Synthetic polypeptide
  [alphaFAP]_H0.26L0.11 Variable heavy (vh) domain

SEQ ID NO: 238 - protein, 5 aa, Artificial Sequence
  Description of Artificial Sequence: Synthetic peptide
  [alphaFAP]_H0.26L0.11 vhCDR1
EYSIH

SEQ ID NO: 239 - protein, 17 aa, Artificial Sequence
  Description of Artificial Sequence: Synthetic peptide
  [alphaFAP]_H0.26L0.11 vhCDR2
GINPNTGIPNYNQKFKG

SEQ ID NO: 240 - protein, 15 aa, Artificial Sequence
  Description of Artificial Sequence: Synthetic peptide
  [alphaFAP]_H0.26L0.11 vhCDR3
RRIAYGYDEGHAMDY

SEQ ID NO: 241 - protein, 113 aa, Artificial Sequence
  Description of Artificial Sequence: Synthetic polypeptide
  [alphaFAP]_H0.26L0.11 Variable light (vl) domain
DIVMTQSPDSLAVSLGERATINCKSSQSLLYSSNQKNYLAWYQQKPGQPPKLLIFWASTRESGVPDRFSGSGFGTDFTLTISSLQAEDVAVYYCQQYFSYPLTFGQGTKVEIK

SEQ ID NO: 242 - protein, 17 aa, Artificial Sequence
  Description of Artificial Sequence: Synthetic peptide
  [alphaFAP]_H0.26L0.11 vlCDR1
KSSQSLLYSSNQKNYLA

SEQ ID NO: 243 - protein, 7 aa, Artificial Sequence
  Description of Artificial Sequence: Synthetic peptide
  [alphaFAP]_H0.26L0.11 vlCDR2
WASTRES

SEQ ID NO: 244 - protein, 9 aa, Artificial Sequence
  Description of Artificial Sequence: Synthetic peptide
  [alphaFAP]_H0.26L0.11 vlCDR3
QQYFSYPLT

SEQ ID NO: 245 - protein, 124 aa, Artificial Sequence; identical to SEQ ID NO: 229
  Description of Artificial Sequence: Synthetic polypeptide
  [alphaFAP]_H0.26L0.19 Variable heavy (vh) domain

SEQ ID NO: 246 - protein, 5 aa, Artificial Sequence
  Description of Artificial Sequence: Synthetic peptide
  [alphaFAP]_H0.26L0.19 vhCDR1
EYSIH

SEQ ID NO: 247 - protein, 17 aa, Artificial Sequence
  Description of Artificial Sequence: Synthetic peptide
  [alphaFAP]_H0.26L0.19 vhCDR2
GINPNTGIPNYNQKFKG

SEQ ID NO: 248 - protein, 15 aa, Artificial Sequence
  Description of Artificial Sequence: Synthetic peptide
  [alphaFAP]_H0.26L0.19 vhCDR3
RRIAYGYDEGHAMDY

SEQ ID NO: 249 - protein, 113 aa, Artificial Sequence
  Description of Artificial Sequence: Synthetic polypeptide
  [alphaFAP]_H0.26L0.19 Variable light (vl) domain
DIVMTQSPDSLAVSLGERATINCKSSQSLLYSRNQENYLAWYQQKPGQPPKLLIFWASTRESGVPDRFSGSGFGTDFTLTISSLQAEDVAVYYCQQYFSYPLTFGQGTKVEIK

SEQ ID NO: 250 - protein, 17 aa, Artificial Sequence
  Description of Artificial Sequence: Synthetic peptide
  [alphaFAP]_H0.26L0.19 vlCDR1
KSSQSLLYSRNQENYLA

SEQ ID NO: 251 - protein, 7 aa, Artificial Sequence
  Description of Artificial Sequence: Synthetic peptide
  [alphaFAP]_H0.26L0.19 vlCDR2
WASTRES

SEQ ID NO: 252 - protein, 9 aa, Artificial Sequence
  Description of Artificial Sequence: Synthetic peptide
  [alphaFAP]_H0.26L0.19 vlCDR3
QQYFSYPLT

SEQ ID NO: 253 - protein, 447 aa, Artificial Sequence
  Description of Artificial Sequence: Synthetic polypeptide
  XENP024444 1A4A5[FAP]_H1L1_IgG1_PVA_/S267K Heavy Chain
EVQLLESGGGLVQPGGSLRLSCAASGFTFSSYAMSWVRQAPGKGLEWVSAISGSGGTTYYADSVKGRFTISRDNSKNTLYLQMNSLRAEDTAVYYCAKDAGRPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 214 aa, Artificial Sequence
  Description of Artificial Sequence: Synthetic polypeptide
  XENP024444 1A4A5[FAP]_H1L1_IgG1_PVA_/S267K Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYKFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 449 aa, Artificial Sequence
  Description of Artificial Sequence: Synthetic polypeptide
  XENP024448 1C3A5[FAP]_H1L1_IgG1_PVA_/S267K Heavy Chain
EVQLLESGGGLVQPGGSLRLSCAASGFTFSSYAMSWVRQAPGKGLEWVSAISGSGGGTRYADSVKGRFTISRDNSKNTLYLQMNSLRAEDTAVYYCAKHSSGFHWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 214 aa, Artificial Sequence
  Description of Artificial Sequence: Synthetic polypeptide
  XENP024448 1C3A5[FAP]_H1L1_IgG1_PVA_/S267K Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 450 aa, Artificial Sequence
  Description of Artificial Sequence: Synthetic polypeptide
  XENP024454 1E5A5[FAP]_H1L1_IgG1_PVA_/S267K Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 214 aa, Artificial Sequence
  Description of Artificial Sequence: Synthetic polypeptide
  XENP024454 1E5A5[FAP]_H1L1_IgG1_PVA_/S267K Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 259 - protein, 448 aa, Artificial Sequence
  Description of Artificial Sequence: Synthetic polypeptide
  XENP024460 1A1B5[FAP]_H1L1_IgG1_PVA_/S267K Heavy Chain
EVQLLESGGGLVQPGGSLRLSCAASGFTFSSYAMNWVRQAPGKGLEWVSTISSSGSRTYYADSVKGRFTISRDNSKNTLYLQMNSLRAEDTAVYYCAKGLVASAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 214 aa, Artificial Sequence
  Description of Artificial Sequence: Synthetic polypeptide
  XENP024460 1A1B5[FAP]_H1L1_IgG1_PVA_/S267K Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 450 aa, Artificial Sequence
  Description of Artificial Sequence: Synthetic polypeptide
  XENP024461 1A7B5[FAP]_H1L1_IgG1_PVA_/S267K Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 214 aa, Artificial Sequence; identical to SEQ ID NO: 260
  Description of Artificial Sequence: Synthetic polypeptide
  XENP024461 1A7B5[FAP]_H1L1_IgG1_PVA_/S267K Light Chain

SEQ ID NO: 263 - protein, 450 aa, Artificial Sequence
  Description of Artificial Sequence: Synthetic polypeptide
  XENP024462 1F4B5[FAP]_H1L1_IgG1_PVA_/S267K Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 214 aa, Artificial Sequence; identical to SEQ ID NO: 260
  Description of Artificial Sequence: Synthetic polypeptide
  XENP024462 1F4B5[FAP]_H1L1_IgG1_PVA_/S267K Light Chain

SEQ ID NO: 265 - protein, 450 aa, Artificial Sequence
  Description of Artificial Sequence: Synthetic polypeptide
  XENP024463 1F11B5[FAP]_H1L1_IgG1_PVA_/S267K Heavy Chain
EVQLLESGGGLVQPGGSLRLSCAASGFTFSSYAMNWVRQAPGKGLEWVSGISGGGSSTTYYADSVKGRFTISRDNSKNTLYLQMNSLRAEDTAVYYCAKPYYWVDSFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - protein, 214 aa, Artificial Sequence; identical to SEQ ID NO: 260
  Description of Artificial Sequence: Synthetic polypeptide
  XENP024463 1F11B5[FAP]_H1L1_IgG1_PVA_/S267K Light Chain

SEQ ID NO: 267 - protein, 450 aa, Artificial Sequence
  Description of Artificial Sequence: Synthetic polypeptide
  XENP024466 1F12B5[FAP]_H1L1_IgG1_PVA_/S267K Heavy Chain
EVQLLESGGGLVQPGGSLRLSCAASGFTFSSYAMTWVRQAPGKGLEWVSTISSSGGTTYYADSVKGRFTISRDNSKNTLYLQMNSLRAEDTAVYYCAKYPSYYSVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 214 aa, Artificial Sequence; identical to SEQ ID NO: 260
  Description of Artificial Sequence: Synthetic polypeptide
  XENP024466 1F12B5[FAP]_H1L1_IgG1_PVA_/S267K Light Chain

SEQ ID NO: 269 - protein, 450 aa, Artificial Sequence
  Description of Artificial Sequence: Synthetic polypeptide
  XENP024469 1D5B5[FAP]_H1L1_IgG1_PVA_/S267K Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKVGFFGLSWGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 214 aa, Artificial Sequence; identical to SEQ ID NO: 260
  Description of Artificial Sequence: Synthetic polypeptide
  XENP024469 1D5B5[FAP]_H1L1_IgG1_PVA_/S267K Light Chain

SEQ ID NO: 271 - protein, 448 aa, Artificial Sequence
  Description of Artificial Sequence: Synthetic polypeptide
  XENP024471 1F10B5[FAP]_H1L1_IgG1_PVA_/S267K Heavy Chain
EVQLLESGGGLVQPGGSLRLSCAASGFTFSSYGMSWVRQAPGKGLEWVSGISGSGSSTHYADSVKGRFTISRDNSKNTLYLQMNSLRAEDTAVYYCAKGTTGLSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - protein, 214 aa, Artificial Sequence; identical to SEQ ID NO: 260
  Description of Artificial Sequence: Synthetic polypeptide
  XENP024471 1F10B5[FAP]_H1L1_IgG1_PVA_/S267K Light Chain

SEQ ID NO: 273 - protein, 453 aa, Artificial Sequence
  Description of Artificial Sequence: Synthetic polypeptide
  XENP023535 sibrotuzumab[FAP]_H0L0_Fab_IgG1_pI(-)_Isosteric_A _/PVA_/S267K/L368D/K370S Fab-Fc Heavy Chain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 274 - protein, 485 aa, Artificial Sequence
  Description of Artificial Sequence: Synthetic polypeptide
  XENP023535 [anti-CD3]_H1.30_L1.47_scFv(GKPGS)4_Fc(216)_IgG1 _C220S/PVA_/S267K/S364K/E357Q scFv-Fc Heavy Chain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 220 aa, Artificial Sequence; identical to SEQ ID NO: 136
  Description of Artificial Sequence: Synthetic polypeptide
  XENP023535 sibrotuzumab[FAP]_L0 Light Chain

SEQ ID NO: 276 - protein, 453 aa, Artificial Sequence; identical to SEQ ID NO: 273
  Description of Artificial Sequence: Synthetic polypeptide
  XENP023536 sibrotuzumab[FAP]_H0L0_Fab_IgG1_pI(-)_Isosteric_A _/PVA_/S267K/L368D/K370S Fab-Fc Heavy Chain

SEQ ID NO: 277 - protein, 485 aa, Artificial Sequence
  Description of Artificial Sequence: Synthetic polypeptide
  XENP023536 [anti-CD3]_H1.32_L1.47_[CD3]_scFv(GKPGS)4_Fc(216) _IgG1_C220S/PVA_/S267K/S364K/E357Q scFv-Fc Heavy Chain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 220 aa, Artificial Sequence; identical to SEQ ID NO: 136
  Description of Artificial Sequence: Synthetic polypeptide
  XENP023536 sibrotuzumab[FAP]_L0 Light Chain

SEQ ID NO: 279 - protein, 446 aa, Artificial Sequence
  Description of Artificial Sequence: Synthetic polypeptide
  XENP023930 29B11[FAP]_H0L0_Fab_IgG1_pI(-)_Isosteric_A_/PVA _/S267K/L368D/K370S Fab-Fc Heavy Chain
EVQLLESGGGLVQPGGSLRLSCAASGFTFSSYAMSWVRQAPGKGLEWVSAIIGSGGITYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 280 - protein, 485 aa, Artificial Sequence; identical to SEQ ID NO: 274
  Description of Artificial Sequence: Synthetic polypeptide
  XENP023930 [anti-CD3]_H1.30_L1.47_scFv(GKPGS)4_Fc(216)_IgG1 _C220S/PVA_/S267K/S364K/E357Q scFv-Fc Heavy Chain

SEQ ID NO: 281 - protein, 215 aa, Artificial Sequence; identical to SEQ ID NO: 138
  Description of Artificial Sequence: Synthetic polypeptide
  XENP023930 29B11[FAP]_L0 Light Chain

SEQ ID NO: 282 - protein, 446 aa, Artificial Sequence; identical to SEQ ID NO: 279
  Description of Artificial Sequence: Synthetic polypeptide
  XENP023931 29B11[FAP]_H0L0_Fab_IgG1_pI(-)_Isosteric_A_/PVA _/S267K/L368D/K370S Fab-Fc Heavy Chain

SEQ ID NO: 283 - protein, 485 aa, Artificial Sequence; identical to SEQ ID NO: 277
  Description of Artificial Sequence: Synthetic polypeptide
  XENP023931 [anti-CD3]_H1.32_L1.47_[CD3]_scFv(GKPGS)4_Fc(216) _IgG1_C220S/PVA_/S267K/S364K/E357Q scFv-Fc Heavy Chain

SEQ ID NO: 284 - protein, 215 aa, Artificial Sequence; identical to SEQ ID NO: 138
  Description of Artificial Sequence: Synthetic polypeptide
  XENP023931 29B11[FAP]_L0 Light Chain

SEQ ID NO: 285 - protein, 446 aa, Artificial Sequence
  Description of Artificial Sequence: Synthetic polypeptide
  XENP023934 3F2[FAP]_H0L0_Fab_IgG1_pI(-)_Isosteric_A_/PVA _/S267K/L368D/K370S Fab-Fc Heavy Chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 286 - protein, 485 aa, Artificial Sequence; identical to SEQ ID NO: 274
  Description of Artificial Sequence: Synthetic polypeptide
  XENP023934 [anti-CD3]_H1.30_L1.47_scFv(GKPGS)4_Fc(216)_IgG1 _C220S/PVA_/S267K/S364K/E357Q scFv-Fc Heavy Chain

SEQ ID NO: 287 - protein, 215 aa, Artificial Sequence; identical to SEQ ID NO: 138
  Description of Artificial Sequence: Synthetic polypeptide
  XENP023934 3F2[FAP]_L0 Light Chain

SEQ ID NO: 288 - protein, 446 aa, Artificial Sequence; identical to SEQ ID NO: 285
  Description of Artificial Sequence: Synthetic polypeptide
  XENP023935 3F2[FAP]_H0L0_Fab_IgG1_pI(-)_Isosteric_A_/PVA _/S267K/L368D/K370S Fab-Fc Heavy Chain

SEQ ID NO: 289 - protein, 485 aa, Artificial Sequence; identical to SEQ ID NO: 277
  Description of Artificial Sequence: Synthetic polypeptide
  XENP023935 [anti-CD3]_H1.32_L1.47_[CD3]_scFv(GKPGS)4_Fc(216) _IgG1_C220S/PVA_/S267K/S364K/E357Q scFv-Fc Heavy Chain

SEQ ID NO: 290 - protein, 215 aa, Artificial Sequence; identical to SEQ ID NO: 138
  Description of Artificial Sequence: Synthetic polypeptide
  XENP023935 3F2[FAP]_L0 Light Chain

SEQ ID NO: 291 - protein, 453 aa, Artificial Sequence; identical to SEQ ID NO: 273
  Description of Artificial Sequence: Synthetic polypeptide
  XENP024472 sibrotuzumab[FAP]_H0L0_Fab_IgG1_pI(-)_Isosteric_A _/PVA_/S267K/L368D/K370S Fab-Fc Heavy Chain

SEQ ID NO: 292 - protein, 485 aa, Artificial Sequence
  Description of Artificial Sequence: Synthetic polypeptide
  XENP024472 [anti-CD3]_H1.33_L1.47_scFv(GKPGS)4_Fc(216)_IgG1 _C220S/PVA_/S267K/S364K/E357Q scFv-Fc Heavy Chain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 220 aa, Artificial Sequence; identical to SEQ ID NO: 136
  Description of Artificial Sequence: Synthetic polypeptide
  XENP024472 sibrotuzumab[FAP]_L0 Light Chain

SEQ ID NO: 294 - protein, 446 aa, Artificial Sequence; identical to SEQ ID NO: 279
  Description of Artificial Sequence: Synthetic polypeptide
  XENP023932 29B11[FAP]_H0L0_Fab_IgG1_PVA_/S267K-pI(-) _Isosteric_A_L368D/K370S Fab-Fc Heavy Chain

SEQ ID NO: 295 - protein, 719 aa, Artificial Sequence
  Description of Artificial Sequence: Synthetic polypeptide
  XENP023932 29B11[FAP]_H0L0_Fab_(G2S)2_IgG1 _C220S/S364K/E357Q Fab-scFv-Fc Heavy Chain
EVQLLESGGGLVQPGGSLRLSCAASGFTFSSYAMSWVRQAPGKGLEWVSAIIGSGGITYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 215 aa, Artificial Sequence; identical to SEQ ID NO: 138
  Description of Artificial Sequence: Synthetic polypeptide
  XENP023932 29B11[FAP]_L0 Light Chain

SEQ ID NO: 297 - protein, 446 aa, Artificial Sequence; identical to SEQ ID NO: 285
  Description of Artificial Sequence: Synthetic polypeptide
  XENP023936 3F2[FAP]_H0L0_Fab_IgG1_PVA_/S267K-pI(-)_Isosteric _A_L368D/K370S Fab-Fc Heavy Chain

SEQ ID NO: 298 - protein, 719 aa, Artificial Sequence
  Description of Artificial Sequence: Synthetic polypeptide
  XENP023936 3F2[FAP]_H0L0_Fab_(G2S)2_IgG1 _C220S/S364K/E357Q Fab-scFv-Fc Heavy Chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 215 aa, Artificial Sequence; identical to SEQ ID NO: 138
  Description of Artificial Sequence: Synthetic polypeptide
  XENP023936 3F2[FAP]_L0 Light Chain

SEQ ID NO: 300 - protein, 453 aa, Artificial Sequence; identical to SEQ ID NO: 273
  Description of Artificial Sequence: Synthetic polypeptide
  XENP024011 sibrotuzumab[FAP]_H0L0_Fab_IgG1_PVA_/S267K-pI(-) _Isosteric_A_L368D/K370S Fab-Fc Heavy Chain

SEQ ID NO: 301 - protein, 726 aa, Artificial Sequence
  Description of Artificial Sequence: Synthetic polypeptide
  XENP024011 sibrotuzumab[FAP]_H0L0_Fab_(G2S)2_IgG1 _C220S/S364K/E357Q Fab-scFv-Fc Heavy Chain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 220 aa, Artificial Sequence; identical to SEQ ID NO: 136
  Description of Artificial Sequence: Synthetic polypeptide
  XENP024011 sibrotuzumab[FAP]_L0 Light Chain

SEQ ID NO: 303 - protein, 453 aa, Artificial Sequence; identical to SEQ ID NO: 273
  Description of Artificial Sequence: Synthetic polypeptide
  XENP024473 sibrotuzumab[FAP]_H0L0_Fab_IgG1_PVA_/S267K-pI(-) _Isosteric_A_L368D/K370S Fab-Fc Heavy Chain

SEQ ID NO: 304 - protein, 726 aa, Artificial Sequence
  Description of Artificial Sequence: Synthetic polypeptide
  XENP024473 sibrotuzumab[FAP]_H0L0_Fab_(G2S)2_IgG1 _C220S/S364K/E357Q Fab-scFv-Fc Heavy Chain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 220 aa, Artificial Sequence; identical to SEQ ID NO: 136
  Description of Artificial Sequence: Synthetic polypeptide
  XENP024473 sibrotuzumab[FAP]_L0 Light Chain

SEQ ID NO: 306 - protein, 453 aa, Artificial Sequence; identical to SEQ ID NO: 273
  Description of Artificial Sequence: Synthetic polypeptide
  XENP024474 sibrotuzumab[FAP]_H0L0_Fab_IgG1_PVA_/S267K-pI(-) _Isosteric_A_L368D/K370S Fab-Fc Heavy Chain

SEQ ID NO: 307 - protein, 726 aa, Artificial Sequence
  Description of Artificial Sequence: Synthetic polypeptide
  XENP024474 sibrotuzumab[FAP]_H0L0_Fab_(G2S)2_IgG1 _C220S/S364K/E357Q Fab-scFv-Fc Heavy Chain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 220 aa, Artificial Sequence; identical to SEQ ID NO: 136
  Description of Artificial Sequence: Synthetic polypeptide
  XENP024474 sibrotuzumab[FAP]_L0 Light Chain

SEQ ID NO: 309 - protein, 449 aa, Artificial Sequence
  Description of Artificial Sequence: Synthetic polypeptide
  XENP013245 Numax_Fab_IgG1_C220S/S364K/E357Q Fab-Fc Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 310 - protein, 485 aa, Artificial Sequence; identical to SEQ ID NO: 274
  Description of Artificial Sequence: Synthetic polypeptide
  XENP013245 [ANTI-CD3]_H1.30_L1.47_scFv(GKPGS)4_Fc(216)_IgG1 _PVA_/S267K_pI(-)_Isosteric_A_L368D/K370S scFv-Fc Heavy Chain

SEQ ID NO: 311 - protein, 213 aa, Artificial Sequence
  Description of Artificial Sequence: Synthetic polypeptide
  XENP013245 Numax_L0 Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 312 - protein, 450 aa, Artificial Sequence
  Description of Artificial Sequence: Synthetic polypeptide
  XENP024704 1E5A5[FAP]_H1L1_Fab_IgG1_pI(-)_Isosteric_A_/PVA _/S267K/L368D/K370S Fab-Fc Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 313 - protein, 485 aa, Artificial Sequence; identical to SEQ ID NO: 274
  Description of Artificial Sequence: Synthetic polypeptide
  XENP024704 [ANTI-CD3]_H1.30_L1.47_scFv(GKPGS)4_Fc(216)_IgG1 _C220S/PVA_/S267K/S364K/E357Q scFv-Fc Heavy Chain

SEQ ID NO: 314 - protein, 214 aa, Artificial Sequence; identical to SEQ ID NO: 258
  Description of Artificial Sequence: Synthetic polypeptide
  XENP024704 1E5A5[FAP]_L1 Light Chain

SEQ ID NO: 315 - protein, 450 aa, Artificial Sequence
  Description of Artificial Sequence: Synthetic polypeptide
  XENP024707 1A7B5[FAP]_H1L1_Fab_IgG1_pI(-)_Isosteric_A_/PVA _/S267K/L368D/K370S Fab-Fc Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 316 - protein, 485 aa, Artificial Sequence; identical to SEQ ID NO: 274
  Description of Artificial Sequence: Synthetic polypeptide
  XENP024707 [ANTI-CD3]_H1.30_L1.47_scFv(GKPGS)4_IgG1_C220S/PVA _/S267K/S364K/E357Q scFv-Fc Heavy Chain

SEQ ID NO: 317 - protein, 214 aa, Artificial Sequence; identical to SEQ ID NO: 260
  Description of Artificial Sequence: Synthetic polypeptide
  XENP024707 1A7B5[FAP]_L1 Light Chain

SEQ ID NO: 318 - protein, 450 aa, Artificial Sequence
  Description of Artificial Sequence: Synthetic polypeptide
  XENP024708 1F4B5[FAP]_H1L1_Fab_IgG1_pI(-)_Isosteric_A_/PVA _/S267K/L368D/K370S Fab-Fc Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 319 - protein, 485 aa, Artificial Sequence; identical to SEQ ID NO: 274
  Description of Artificial Sequence: Synthetic polypeptide
  XENP024708 [ANTI-CD3]_H1.30_L1.47_scFv(GKPGS)4_Fc(216)_IgG1 _C220S/PVA_/S267K/S364K/E357Q scFv-Fc Heavy Chain

SEQ ID NO: 320 - protein, 214 aa, Artificial Sequence; identical to SEQ ID NO: 260
  Description of Artificial Sequence: Synthetic polypeptide
  XENP024708 1F4B5[FAP]_L1 Light Chain

SEQ ID NO: 321 - protein, 450 aa, Artificial Sequence
  Description of Artificial Sequence: Synthetic polypeptide
  XENP024710 1F12B5[FAP]_H1L1_Fab_IgG1_pI(-)_Isosteric_A_/PVA _/S267K/L368D/K370S Fab-Fc Heavy Chain
EVQLLESGGGLVQPGGSLRLSCAASGFTFSSYAMTWVRQAPGKGLEWVSTISSSGGTTYYADSVKGRFTISRDNSKNTLYLQMNSLRAEDTAVYYCAKYPSYYSVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 322 - protein, 485 aa, Artificial Sequence; identical to SEQ ID NO: 274
  Description of Artificial Sequence: Synthetic polypeptide
  XENP024710 [ANTI-CD3]_H1.30_L1.47_scFv(GKPGS)4_Fc(216)_IgG1 _C220S/PVA_/S267K/S364K/E357Q scFv-Fc Heavy Chain

SEQ ID NO: 323 - protein, 214 aa, Artificial Sequence; identical to SEQ ID NO: 260
  Description of Artificial Sequence: Synthetic polypeptide
  XENP024710 1F12B5[FAP]_L1 Light Chain

SEQ ID NO: 324 - protein, 448 aa, Artificial Sequence
  Description of Artificial Sequence: Synthetic polypeptide
  XENP024712 1F10B5[FAP]_H1L1_Fab_IgG1_pI(-)_Isosteric_A_/PVA _/S267K/L368D/K370S Fab-Fc Heavy Chain
EVQLLESGGGLVQPGGSLRLSCAASGFTFSSYGMSWVRQAPGKGLEWVSGISGSGSSTHYADSVKGRFTISRDNSKNTLYLQMNSLRAEDTAVYYCAKGTTGLSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 325 - protein, 485 aa, Artificial Sequence; identical to SEQ ID NO: 274
  Description of Artificial Sequence: Synthetic polypeptide
  XENP024712 [ANTI-CD3]_H1.30_L1.47_scFv(GKPGS)4_Fc(216)_IgG1 _C220S/PVA_/S267K/S364K/E357Q scFv-Fc Heavy Chain

SEQ ID NO: 326 - protein, 214 aa, Artificial Sequence; identical to SEQ ID NO: 260
  Description of Artificial Sequence: Synthetic polypeptide
  XENP024712 1F10B5[FAP]_L1 Light Chain

SEQ ID NO: 327 - protein, 450 aa, Artificial Sequence; identical to SEQ ID NO: 321
  Description of Artificial Sequence: Synthetic polypeptide
  XENP024713 1F12B5[FAP]_H1L1_Fab_IgG1_pI(-)_Isosteric_A_/PVA _/S267K/L368D/K370S Fab-Fc Heavy Chain

SEQ ID NO: 328 - protein, 485 aa, Artificial Sequence; identical to SEQ ID NO: 277
  Description of Artificial Sequence: Synthetic polypeptide
  XENP024713 [ANTI-CD3]_H1.32_L1.47_scFv(GKPGS)4_Fc(216)_IgG1 _C220S/PVA_/S267K/S364K/E357Q scFv-Fc Heavy Chain

SEQ ID NO: 329 - protein, 214 aa, Artificial Sequence; identical to SEQ ID NO: 260
  Description of Artificial Sequence: Synthetic polypeptide
  XENP024713 1F12B5[FAP]_L1 Light Chain

SEQ ID NO: 330 - protein, 450 aa, Artificial Sequence; identical to SEQ ID NO: 318
  Description of Artificial Sequence: Synthetic polypeptide
  XENP024715 1F4B5[FAP]_H1L1_Fab_IgG1_pI(-)_Isosteric_A_/PVA _/S267K/L368D/K370S Fab-Fc Heavy Chain

SEQ ID NO: 331 - protein, 485 aa, Artificial Sequence; identical to SEQ ID NO: 277
  Description of Artificial Sequence: Synthetic polypeptide
  XENP024715 [ANTI-CD3]_H1.32_L1.47_scFv(GKPGS)4_Fc(216)_IgG1 _C220S/PVA_/S267K/S364K/E357Q scFv-Fc Heavy Chain

SEQ ID NO: 332 - protein, 214 aa, Artificial Sequence; identical to SEQ ID NO: 260
  Description of Artificial Sequence: Synthetic polypeptide
  XENP024715 1F4B5[FAP]_L1 Light Chain

SEQ ID NO: 333 - protein, 448 aa, Artificial Sequence; identical to SEQ ID NO: 324
  Description of Artificial Sequence: Synthetic polypeptide
  XENP024802 1F10B5[FAP]_H1L1_Fab_IgG1_pI(-)_Isosteric_A_/PVA _/S267K/L368D/K370S Fab-Fc Heavy Chain

SEQ ID NO: 334 - protein, 485 aa, Artificial Sequence; identical to SEQ ID NO: 277
  Description of Artificial Sequence: Synthetic polypeptide
  XENP024802 [ANTI-CD3]_H1.32_L1.47_scFv(GKPGS)4_Fc(216)_IgG1 _C220S/PVA_/S267K/S364K/E357Q scFv-Fc Heavy Chain

SEQ ID NO: 335 - protein, 214 aa, Artificial Sequence; identical to SEQ ID NO: 260
  Description of Artificial Sequence: Synthetic polypeptide
  XENP024802 1F10B5[FAP]_L1 Light Chain

SEQ ID NO: 336 - protein, 450 aa, Artificial Sequence; identical to SEQ ID NO: 315
  Description of Artificial Sequence: Synthetic polypeptide
  XENP025384 1A7B5[FAP]_H1L1_Fab_IgG1_pI(-)_Isosteric_A_/PVA _/S267K/L368D/K370S Fab-Fc Heavy Chain

SEQ ID NO: 337 - protein, 485 aa, Artificial Sequence; identical to SEQ ID NO: 277
  Description of Artificial Sequence: Synthetic polypeptide
  XENP025384 [ANTI-CD3]_H1.32_L1.47_scFv(GKPGS)4_Fc(216)_IgG1 _C220S/PVA_/S267K/S364K/E357Q scFv-Fc Heavy Chain

SEQ ID NO: 338 - protein, 214 aa, Artificial Sequence; identical to SEQ ID NO: 260
  Description of Artificial Sequence: Synthetic polypeptide
  XENP025384 1A7B5[FAP]_L1 Light Chain

SEQ ID NO: 339 - protein, 450 aa, Artificial Sequence; identical to SEQ ID NO: 312
  Description of Artificial Sequence: Synthetic polypeptide
  XENP025965 1E5A5(commonLC)[FAP]_H1L1_Fab_IgG1_pI(-)_Isosteric _A_/PVA_/S267K/L368D/K370S Fab-Fc Heavy Chain

SEQ ID NO: 340 - protein, 485 aa, Artificial Sequence; identical to SEQ ID NO: 274
  Description of Artificial Sequence: Synthetic polypeptide
  XENP025965 [ANTI-CD3]_H1.30_L1.47_scFv(GKPGS)4_Fc(216)_IgG1 _C220S/PVA_/S267K/S364K/E357Q scFv-Fc Heavy Chain

SEQ ID NO: 341 - protein, 214 aa, Artificial Sequence; identical to SEQ ID NO: 260
  Description of Artificial Sequence: Synthetic polypeptide
  XENP025965 1E5A5(commonLC)[FAP]_L1 Light Chain

SEQ ID NO: 342 - protein, 450 aa, Artificial Sequence; identical to SEQ ID NO: 321
  Description of Artificial Sequence: Synthetic polypeptide
  XENP025185 1F12B5[FAP]_H1L1_IgG1_PVA_/S267K-pI(-)_Isosteric_A _L368D/K370S Heavy Chain

SEQ ID NO: 343 - protein, 723 aa, Artificial Sequence
  Description of Artificial Sequence: Synthetic polypeptide
  XENP025185 1F12B5[FAP]_H1L1_Fab_(G4S)2_[ANTI-CD3]_H1.30_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYAMTWVRQAPGKGLEWVSTISSSGGTTYYADSVKGRFTISRDNSKNTLYLQMNSLRAEDTAVYYCAKYPSYYSVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 344 - protein, 214 aa, Artificial Sequence; identical to SEQ ID NO: 260
  Description of Artificial Sequence: Synthetic polypeptide
  XENP025185 1F12B5[FAP]_L1 Light Chain

SEQ ID NO: 345 - protein, 448 aa, Artificial Sequence; identical to SEQ ID NO: 324
  Description of Artificial Sequence: Synthetic polypeptide
  XENP025186 1F10B5[FAP]_H1L1_IgG1_PVA_/S267K-pI(-)_Isosteric_A _L368D/K370S Heavy Chain

SEQ ID NO: 346 - protein, 721 aa, Artificial Sequence
  Description of Artificial Sequence: Synthetic polypeptide
  XENP025186 1F10B5[FAP]_H1L1_Fab_(G4S)2_[ANTI-CD3]_H1.30_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYGMSWVRQAPGKGLEWVSGISGSGSSTHYADSVKGRFTISRDNSKNTLYLQMNSLRAEDTAVYYCAKGTTGLSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 214 aa, Artificial Sequence; identical to SEQ ID NO: 260
  Description of Artificial Sequence: Synthetic polypeptide
  XENP025186 1F10B5[FAP]_L1 Light Chain

SEQ ID NO: 348 - protein, 450 aa, Artificial Sequence; identical to SEQ ID NO: 318
  Description of Artificial Sequence: Synthetic polypeptide
  XENP025187 1F4B5[FAP]_H1L1_IgG1_PVA_/S267K-pI(-)_Isosteric_A _L368D/K370S Heavy Chain

SEQ ID NO: 349 - protein, 723 aa, Artificial Sequence
  Description of Artificial Sequence: Synthetic polypeptide
  XENP025187 1F4B5[FAP]_H1L1_Fab_(G4S)2_[ANTI-CD3]_H1.30_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 214 aa, Artificial Sequence; identical to SEQ ID NO: 260
  Description of Artificial Sequence: Synthetic polypeptide
  XENP025187 1F4B5[FAP]_L1 Light Chain

SEQ ID NO: 351 - protein, 450 aa, Artificial Sequence; identical to SEQ ID NO: 312
  Description of Artificial Sequence: Synthetic polypeptide
  XENP025188 1E5A5(commonLC)[FAP]_H1L1_IgG1_PVA_/S267K-pI(-) _Isosteric_A_L368D/K370S Heavy Chain

SEQ ID NO: 352 - protein, 723 aa, Artificial Sequence
  Description of Artificial Sequence: Synthetic polypeptide
  XENP025188 1E5A5(commonLC)[FAP]_H1L1_Fab_(G4S)2_[ANTI-CD3] _H1.30_L1.47_scFv(GKPGS)4_(G4S)2_IgG1_C220S/S364K/E357Q Fab-scFv-Fc Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 214 aa, Artificial Sequence; identical to SEQ ID NO: 260
  Description of Artificial Sequence: Synthetic polypeptide
  XENP025188 1E5A5(commonLC)[FAP]_L1 Light Chain

SEQ ID NO: 354 - protein, 450 aa, Artificial Sequence; identical to SEQ ID NO: 315
  Description of Artificial Sequence: Synthetic polypeptide
  XENP025189 1A7B5[FAP]_H1L1_Fab_IgG1_PVA_/S267K-pI(-) _Isosteric_A_L368D/K370S Fab-Fc Heavy Chain

SEQ ID NO: 355 - protein, 723 aa, Artificial Sequence
  Description of Artificial Sequence: Synthetic polypeptide
  XENP025189 1A7B5[FAP]_H1L1_Fab_(G4S)2_[ANTI-CD3]_H1.30_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 214 aa, Artificial Sequence; identical to SEQ ID NO: 260
  Description of Artificial Sequence: Synthetic polypeptide
  XENP025189 1A7B5[FAP]_L1 Light Chain

SEQ ID NO: 357 - protein, 450 aa, Artificial Sequence; identical to SEQ ID NO: 321
  Description of Artificial Sequence: Synthetic polypeptide
  XENP025191 1F12B5[FAP]_H1L1_IgG1_PVA_/S267K-pI(-)_Isosteric_A _L368D/K370S Heavy Chain

SEQ ID NO: 358 - protein, 723 aa, Artificial Sequence
  Description of Artificial Sequence: Synthetic polypeptide
  XENP025191 1F12B5[FAP]_H1L1_Fab_(G4S)2_[ANTI-CD3]_H1.32_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYAMTWVRQAPGKGLEWVSTISSSGGTTYYADSVKGRFTISRDNSKNTLYLQMNSLRAEDTAVYYCAKYPSYYSVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 214 aa, Artificial Sequence; identical to SEQ ID NO: 260
  Description of Artificial Sequence: Synthetic polypeptide
  XENP025191 1F12B5[FAP]_L1 Light Chain

SEQ ID NO: 360 - protein, 448 aa, Artificial Sequence; identical to SEQ ID NO: 324
  Description of Artificial Sequence: Synthetic polypeptide
  XENP025192 1F10B5[FAP]_H1L1_IgG1_PVA_/S267K-pI(-)_Isosteric_A _L368D/K370S Heavy Chain

SEQ ID NO: 361 - protein, 721 aa, Artificial Sequence
  Description of Artificial Sequence: Synthetic polypeptide
  XENP025192 1F10B5[FAP]_H1L1_Fab_(G4S)2_[ANTI-CD3]_H1.32_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYGMSWVRQAPGKGLEWVSGISGSGSSTHYADSVKGRFTISRDNSKNTLYLQMNSLRAEDTAVYYCAKGTTGLSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 214 aa, Artificial Sequence; identical to SEQ ID NO: 260
  Description of Artificial Sequence: Synthetic polypeptide
  XENP025192 1F10B5[FAP]_L1 Light Chain

SEQ ID NO: 363 - protein, 450 aa, Artificial Sequence; identical to SEQ ID NO: 318
  Description of Artificial Sequence: Synthetic polypeptide
  XENP025193 1F4B5[FAP]_H1L1_IgG1_PVA_/S267K-pI(-)_Isosteric_A _L368D/K370S Heavy Chain

SEQ ID NO: 364 - protein, 723 aa, Artificial Sequence
  Description of Artificial Sequence: Synthetic polypeptide
  XENP025193 1F4B5[FAP]_H1L1_Fab_(G4S)2_[ANTI-CD3]_H1.32_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 365 - protein, 214 aa, Artificial Sequence; identical to SEQ ID NO: 260
  Description of Artificial Sequence: Synthetic polypeptide
  XENP025193 1F4B5[FAP]_L1 Light Chain

SEQ ID NO: 366 - protein, 450 aa, Artificial Sequence; identical to SEQ ID NO: 312
  Description of Artificial Sequence: Synthetic polypeptide
  XENP025194 1E5A5(commonLC)[FAP]_H1L1_IgG1_PVA_/S267K-pI(-) _Isosteric_A_L368D/K370S Heavy Chain

SEQ ID NO: 367 - protein, 723 aa, Artificial Sequence
  Description of Artificial Sequence: Synthetic polypeptide
  XENP025194 1E5A5(commonLC)[FAP]_H1L1_Fab_(G4S)2_[ANTI-CD3] _H1.32_L1.47_scFv(GKPGS)4_(G4S)2_IgG1_C220S/S364K/E357Q Fab-scFv-Fc Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 368 - protein, 214 aa, Artificial Sequence; identical to SEQ ID NO: 260
  Description of Artificial Sequence: Synthetic polypeptide
  XENP025194 1E5A5(commonLC)[FAP]_L1 Light Chain

SEQ ID NO: 369 - protein, 450 aa, Artificial Sequence; identical to SEQ ID NO: 315
  Description of Artificial Sequence: Synthetic polypeptide
  XENP025195 1A7B5[FAP]_H1L1_IgG1_PVA_/S267K-pI(-)_Isosteric_A _L368D/K370S Heavy Chain

SEQ ID NO: 370 - protein, 723 aa, Artificial Sequence
  Description of Artificial Sequence: Synthetic polypeptide
  XENP025195 1A7B5[FAP]_H1L1_Fab_(G4S)2_[ANTI-CD3]_H1.32_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 214 aa, Artificial Sequence; identical to SEQ ID NO: 260
  Description of Artificial Sequence: Synthetic polypeptide
  XENP025195 1A7B5[FAP]_L1 Light Chain

SEQ ID NO: 372 - protein, 449 aa, Artificial Sequence
  Description of Artificial Sequence: Synthetic polypeptide
  XENP025196 1C3A5[FAP]_H1L1_IgG1_PVA_/S267K-pI(-)_Isosteric_A _L368D/K370S Heavy Chain
EVQLLESGGGLVQPGGSLRLSCAASGFTFSSYAMSWVRQAPGKGLEWVSAISGSGGGTRYADSVKGRFTISRDNSKNTLYLQMNSLRAEDTAVYYCAKHSSGFHWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 373 - protein, 722 aa, Artificial Sequence
  Description of Artificial Sequence: Synthetic polypeptide
  XENP025196 1C3A5[FAP]_H1L1_Fab_(G4S)2_[ANTI-CD3]_H1.32_L1.47 _scFv(GKPGS)4_(G4S)2_IgG1_C220S/S364K/E357Q Fab-scFv-Fc Heavy Chain
EVQLLESGGGLVQPGGSLRLSCAASGFTFSSYAMSWVRQAPGKGLEWVSAISGSGGGTRYADSVKGRFTISRDNSKNTLYLQMNSLRAEDTAVYYCAKHSSGFHWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 214 aa, Artificial Sequence; identical to SEQ ID NO: 256
  Description of Artificial Sequence: Synthetic polypeptide
  XENP025196 1C3A5[FAP]_L1 Light Chain

SEQ ID NO: 375 - protein, 450 aa, Artificial Sequence; identical to SEQ ID NO: 312
  Description of Artificial Sequence: Synthetic polypeptide
  XENP025966 1E5A5[FAP]_H1L1_IgG1_PVA_/S267K-pI(-)_Isosteric_A _L368D/K370S Heavy Chain

SEQ ID NO: 376 - protein, 723 aa, Artificial Sequence; identical to SEQ ID NO: 352
  Description of Artificial Sequence: Synthetic polypeptide
  XENP025966 1E5A5[FAP]_H1L1_Fab_(G4S)2_[ANTI-CD3]_H1.30_L1.47 _scFv(GKPGS)4_(G4S)2_IgG1 _C220S/S364K/E357Q Fab-scFv-Fc Heavy Chain

SEQ ID NO: 377 - protein, 214 aa, Artificial Sequence; identical to SEQ ID NO: 258
  Description of Artificial Sequence: Synthetic polypeptide
  XENP025966 1E5A5[FAP]_L1 Light Chain

SEQ ID NO: 378 - protein, 450 aa, Artificial Sequence; identical to SEQ ID NO: 312
  Description of Artificial Sequence: Synthetic polypeptide
  XENP025967 1E5A5[FAP]_H1L1_IgG1_PVA_/S267K-pI(-)_Isosteric_A _L368D/K370S Heavy Chain

SEQ ID NO: 379 - protein, 723 aa, Artificial Sequence; identical to SEQ ID NO: 367
  Description of Artificial Sequence: Synthetic polypeptide
  XENP025967 1E5A5[FAP]_H1L1_Fab_(G4S)2_[ANTI-CD3]_H1.32_L1.47 _scFv(GKPGS)4_(G4S)2_IgG1 _C220S/S364K/E357Q Fab-scFv-Fc Heavy Chain

SEQ ID NO: 380 - protein, 214 aa, Artificial Sequence; identical to SEQ ID NO: 258
  Description of Artificial Sequence: Synthetic polypeptide
  XENP025967 1E5A5[FAP]_L1 Light Chain

SEQ ID NO: 381 - protein, 530 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMIL

SEQ ID NO: 382 - protein, 229 aa, Artificial Sequence
  Description of Artificial Sequence: Synthetic polypeptide
  XENP23533 Chain 1 - [aFAP]_H0
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 383 - protein, 220 aa, Artificial Sequence; identical to SEQ ID NO: 136
  Description of Artificial Sequence: Synthetic polypeptide
  XENP23533 Chain 2 - [aFAP]_L0

SEQ ID NO: 384 - protein, 229 aa, Artificial Sequence
  Description of Artificial Sequence: Synthetic polypeptide
  XENP24774 Chain 1 - [aFAP]_H0.1
QVQLVQSGAEVKKPGASVKVSCKASRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 385 - protein, 220 aa, Artificial Sequence; identical to SEQ ID NO: 136
  Description of Artificial Sequence: Synthetic polypeptide
  XENP24774 Chain 2 - [aFAP]_L0

SEQ ID NO: 386 - protein, 229 aa, Artificial Sequence
  Description of Artificial Sequence: Synthetic polypeptide
  XENP24775 Chain 1 - [aFAP]_H0.2
QVQLVQSGAEVKKPGASVKVSCKTSGYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 387 - protein, 220 aa, Artificial Sequence; identical to SEQ ID NO: 136
  Description of Artificial Sequence: Synthetic polypeptide
  XENP24775 Chain 2 - [aFAP]_L0

SEQ ID NO: 388 - protein, 229 aa, Artificial Sequence
  Description of Artificial Sequence: Synthetic polypeptide
  XENP24776 Chain 1 - [aFAP]_H0.3
QVQLVQSGAEVKKPGASVKVSCKASGYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 389 - protein, 220 aa, Artificial Sequence; identical to SEQ ID NO: 136
  Description of Artificial Sequence: Synthetic polypeptide
  XENP24776 Chain 2 - [aFAP]_L0

SEQ ID NO: 390 - protein, 229 aa, Artificial Sequence
  Description of Artificial Sequence: Synthetic polypeptide
  XENP24777 Chain 1 - [aFAP]_H0.4
QVQLVQSGAEVKKPGASVKVSCKTSRYTFTEYYIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 391 - protein, 220 aa, Artificial Sequence; identical to SEQ ID NO: 136
  Description of Artificial Sequence: Synthetic polypeptide
  XENP24777 Chain 2 - [aFAP]_L0

SEQ ID NO: 392 - protein, 229 aa, Artificial Sequence
  Description of Artificial Sequence: Synthetic polypeptide
  XENP24778 Chain 1 - [aFAP]_H0.5
QVQLVQSGAEVKKPGASVKVSCKTSRYTFTEYAIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 393 - protein, 220 aa, Artificial Sequence; identical to SEQ ID NO: 136
  Description of Artificial Sequence: Synthetic polypeptide
  XENP24778 Chain 2 - [aFAP]_L0

SEQ ID NO: 394 - protein, 229 aa, Artificial Sequence
  Description of Artificial Sequence: Synthetic polypeptide
  XENP24779 Chain 1 - [aFAP]_H0.6
QVQLVQSGAEVKKPGASVKVSCKTSRYTFTEYSIHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 395 - protein, 220 aa, Artificial Sequence; identical to SEQ ID NO: 136
  Description of Artificial Sequence: Synthetic polypeptide
  XENP24779 Chain 2 - [aFAP]_L0

SEQ ID NO: 396 - protein, 229 aa, Artificial Sequence
  Description of Artificial Sequence: Synthetic polypeptide
  XENP24780 Chain 1 - [aFAP]_H0.7
QVQLVQSGAEVKKPGASVKVSCKTSRYTFTEYTMHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 397 - protein, 220 aa, Artificial Sequence; identical to SEQ ID NO: 136
  Description of Artificial Sequence: Synthetic polypeptide
  XENP24780 Chain 2 - [aFAP]_L0

SEQ ID NO: 398 - protein, 229 aa, Artificial Sequence
  Description of Artificial Sequence: Synthetic polypeptide
  XENP24781 Chain 1 - [aFAP]_H0.8
QVQLVQSGAEVKKPGASVKVSCKTSRYTFTEYTLHWVRQAPGQRLEWIGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 399 - protein, 220 aa, Artificial Sequence; identical to SEQ ID NO: 136
  Description of Artificial Sequence: Synthetic polypeptide
  XENP24781 Chain 2 - [aFAP]_L0

SEQ ID NO: 400 - protein, 329 aa, Artificial Sequence; identical to SEQ ID NO: 31
  Description of Artificial Sequence: Synthetic polypeptide
  2+1 - H1.30_L1.47 - no Xtend Chain 1

SEQ ID NO: 401 - protein, 489 aa, Artificial Sequence
  Description of Artificial Sequence: Synthetic polypeptide
  2+1 - H1.30_L1.47 - no Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 107 aa, Artificial Sequence [sequence omitted]

SEQ ID NO: 403 - protein, 329 aa, Artificial Sequence; identical to SEQ ID NO: 31
  Description of Artificial Sequence: Synthetic polypeptide
  2+1 - H1.32_L1.47 - no Xtend Chain 1

SEQ ID NO: 404 - protein, 489 aa, Artificial Sequence
  Description of Artificial Sequence: Synthetic polypeptide
  2+1 - H1.32_L1.47 - no Xtend Chain 2
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 107 aa, Artificial Sequence [sequence omitted]

SEQ ID NO: 406 - protein, 329 aa, Artificial Sequence; identical to SEQ ID NO: 31
  Description of Artificial Sequence: Synthetic polypeptide
  2+1 - H1.89_L1.47 - no Xtend Chain 1

SEQ ID NO: 407 - protein, 489 aa, Artificial Sequence
  Description of Artificial Sequence: Synthetic polypeptide
  2+1 - H1.89_L1.47 - no Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 107 aa, Artificial Sequence [sequence omitted]

SEQ ID NO: 409 - protein, 329 aa, Artificial Sequence; identical to SEQ ID NO: 31
  Description of Artificial Sequence: Synthetic polypeptide
  2+1 - H1.90_L1.47 - no Xtend Chain 1

SEQ ID NO: 410 - protein, 489 aa, Artificial Sequence
  Description of Artificial Sequence: Synthetic polypeptide
  2+1 - H1.90_L1.47 - no Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 107 aa, Artificial Sequence [sequence omitted]

SEQ ID NO: 412 - protein, 329 aa, Artificial Sequence; identical to SEQ ID NO: 31
  Description of Artificial Sequence: Synthetic polypeptide
  2+1 - H1.33_L1.47 - no Xtend Chain 1

SEQ ID NO: 413 - protein, 490 aa, Artificial Sequence
  Description of Artificial Sequence: Synthetic polypeptide
  2+1 - H1.33_L1.47 - no Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - protein, 107 aa, Artificial Sequence [sequence omitted]

SEQ ID NO: 415 - protein, 329 aa, Artificial Sequence; identical to SEQ ID NO: 31
  Description of Artificial Sequence: Synthetic polypeptide
  2+1 - H1.31_L1.47 - no Xtend Chain 1

SEQ ID NO: 416 - protein, 489 aa, Artificial Sequence
  Description of Artificial Sequence: Synthetic polypeptide
  2+1 - H1.31_L1.47 - no Xtend Chain 2
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 107 aa, Artificial Sequence [sequence omitted]

SEQ ID NO: 418 - protein, 329 aa, Artificial Sequence; identical to SEQ ID NO: 31
  Description of Artificial Sequence: Synthetic polypeptide
  2+1 - L1.47_ H1.30 - no Xtend Chain 1

SEQ ID NO: 419 - protein, 489 aa, Artificial Sequence
  Description of Artificial Sequence: Synthetic polypeptide
  2+1 - L1.47_ H1.30 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 107 aa, Artificial Sequence [sequence omitted]

SEQ ID NO: 421 - protein, 329 aa, Artificial Sequence; identical to SEQ ID NO: 31
  Description of Artificial Sequence: Synthetic polypeptide
  2+1 - L1.47_ H1.32 - no Xtend Chain 1

SEQ ID NO: 422 - protein, 489 aa, Artificial Sequence
  Description of Artificial Sequence: Synthetic polypeptide
  2+1 - L1.47_ H1.32 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 423 - protein, 107 aa, Artificial Sequence [sequence omitted]

SEQ ID NO: 424 - protein, 329 aa, Artificial Sequence; identical to SEQ ID NO: 31
  Description of Artificial Sequence: Synthetic polypeptide
  2+1 - L1.47_ H1.89 - no Xtend Chain 1

SEQ ID NO: 425 - protein, 490 aa, Artificial Sequence
  Description of Artificial Sequence: Synthetic polypeptide
  2+1 - L1.47_ H1.89 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - protein, 107 aa, Artificial Sequence [sequence omitted]

SEQ ID NO: 427 - protein, 329 aa, Artificial Sequence; identical to SEQ ID NO: 31
  Description of Artificial Sequence: Synthetic polypeptide
  2+1 - L1.47_ H1.90 - no Xtend Chain 1

SEQ ID NO: 428 - protein, 489 aa, Artificial Sequence
  Description of Artificial Sequence: Synthetic polypeptide
  2+1 - L1.47_ H1.90 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 429 - protein, 107 aa, Artificial Sequence [sequence omitted]

SEQ ID NO: 430 - protein, 329 aa, Artificial Sequence; identical to SEQ ID NO: 31
  Description of Artificial Sequence: Synthetic polypeptide
  2+1 - L1.47_ H1.33 - no Xtend Chain 1

SEQ ID NO: 431 - protein, 489 aa, Artificial Sequence
  Description of Artificial Sequence: Synthetic polypeptide
  2+1 - L1.47_ H1.33 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - protein, 107 aa, Artificial Sequence [sequence omitted]

SEQ ID NO: 433 - protein, 329 aa, Artificial Sequence; identical to SEQ ID NO: 31
  Description of Artificial Sequence: Synthetic polypeptide
  2+1 - L1.47_ H1.31 - no Xtend Chain 1

SEQ ID NO: 434 - protein, 489 aa, Artificial Sequence
  Description of Artificial Sequence: Synthetic polypeptide
  2+1 - L1.47_ H1.31 - no Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 107 aa, Artificial Sequence [sequence omitted]

SEQ ID NO: 436 - protein, 329 aa, Artificial Sequence; identical to SEQ ID NO: 51
  Description of Artificial Sequence: Synthetic polypeptide
  2+1 - H1.30_L1.47 - with Xtend Chain 1

SEQ ID NO: 437 - protein, 489 aa, Artificial Sequence
  Description of Artificial Sequence: Synthetic polypeptide
  2+1 - H1.30_L1.47 - with Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 438 - protein, 107 aa, Artificial Sequence [sequence omitted]

SEQ ID NO: 439 - protein, 329 aa, Artificial Sequence; identical to SEQ ID NO: 51
  Description of Artificial Sequence: Synthetic polypeptide
  2+1 - H1.32_L1.47 - with Xtend Chain 1

SEQ ID NO: 440 - protein, 489 aa, Artificial Sequence
  Description of Artificial Sequence: Synthetic polypeptide
  2+1 - H1.32_L1.47 - with Xtend Chain 2
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 441 - protein, 107 aa, Artificial Sequence [sequence omitted]

SEQ ID NO: 442 - protein, 329 aa, Artificial Sequence; identical to SEQ ID NO: 51
  Description of Artificial Sequence: Synthetic polypeptide
  2+1 - H1.89_L1.47 - with Xtend Chain 1

SEQ ID NO: 443 - protein, 489 aa, Artificial Sequence
  Description of Artificial Sequence: Synthetic polypeptide
  2+1 - H1.89_L1.47 - with Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 444 - protein, 107 aa, Artificial Sequence [sequence omitted]

SEQ ID NO: 445 - protein, 329 aa, Artificial Sequence; identical to SEQ ID NO: 51
  Description of Artificial Sequence: Synthetic polypeptide
  2+1 - H1.90_L1.47 - with Xtend Chain 1

SEQ ID NO: 446 - protein, 489 aa, Artificial Sequence
  Description of Artificial Sequence: Synthetic polypeptide
  2+1 - H1.90_L1.47 - with Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 447 - protein, 107 aa, Artificial Sequence [sequence omitted]

SEQ ID NO: 448 - protein, 329 aa, Artificial Sequence; identical to SEQ ID NO: 51
  Description of Artificial Sequence: Synthetic polypeptide
  2+1 - H1.33_L1.47 - with Xtend Chain 1

SEQ ID NO: 449 - protein, 489 aa, Artificial Sequence
  Description of Artificial Sequence: Synthetic polypeptide
  2+1 - H1.33_L1.47 - with Xtend Chain 2
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 450 - protein, 107 aa, Artificial Sequence [sequence omitted]

SEQ ID NO: 451 - protein, 329 aa, Artificial Sequence; identical to SEQ ID NO: 51
  Description of Artificial Sequence: Synthetic polypeptide
  2+1 - H1.31_L1.47 - with Xtend Chain 1

SEQ ID NO: 452 - protein, 489 aa, Artificial Sequence
  Description of Artificial Sequence: Synthetic polypeptide
  2+1 - H1.31_L1.47 - with Xtend Chain 2
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 453 - protein, 107 aa, Artificial Sequence [sequence omitted]

SEQ ID NO: 454 - protein, 329 aa, Artificial Sequence; identical to SEQ ID NO: 51
  Description of Artificial Sequence: Synthetic polypeptide
  2+1 - L1.47_ H1.30 - with Xtend Chain 1

SEQ ID NO: 455 - protein, 489 aa, Artificial Sequence
  Description of Artificial Sequence: Synthetic polypeptide
  2+1 - L1.47_ H1.30 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 456 - protein, 107 aa, Artificial Sequence [sequence omitted]

SEQ ID NO: 457 - protein, 329 aa, Artificial Sequence; identical to SEQ ID NO: 51
  Description of Artificial Sequence: Synthetic polypeptide
  2+1 - L1.47_ H1.32 - with Xtend Chain 1

SEQ ID NO: 458 - protein, 489 aa, Artificial Sequence
  Description of Artificial Sequence: Synthetic polypeptide
  2+1 - L1.47_ H1.32 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 459 - protein, 107 aa, Artificial Sequence [sequence omitted]

SEQ ID NO: 460 - protein, 329 aa, Artificial Sequence; identical to SEQ ID NO: 51
  Description of Artificial Sequence: Synthetic polypeptide
  2+1 - L1.47_ H1.89 - with Xtend Chain 1

SEQ ID NO: 461 - protein, 489 aa, Artificial Sequence
  Description of Artificial Sequence: Synthetic polypeptide
  2+1 - L1.47_ H1.89 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 462 - protein, 107 aa, Artificial Sequence [sequence omitted]

SEQ ID NO: 463 - protein, 329 aa, Artificial Sequence; identical to SEQ ID NO: 51
  Description of Artificial Sequence: Synthetic polypeptide
  2+1 - L1.47_ H1.90 - with Xtend Chain 1

SEQ ID NO: 464 - protein, 489 aa, Artificial Sequence
  Description of Artificial Sequence: Synthetic polypeptide
  2+1 - L1.47_ H1.90 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 465 - protein, 107 aa, Artificial Sequence [sequence omitted]

SEQ ID NO: 466 - protein, 329 aa, Artificial Sequence; identical to SEQ ID NO: 51
  Description of Artificial Sequence: Synthetic polypeptide
  2+1 - L1.47_ H1.33 - with Xtend Chain 1

SEQ ID NO: 467 - protein, 489 aa, Artificial Sequence
  Description of Artificial Sequence: Synthetic polypeptide
  2+1 - L1.47_ H1.33 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 468 - protein, 107 aa, Artificial Sequence [sequence omitted]

SEQ ID NO: 469 - protein, 329 aa, Artificial Sequence; identical to SEQ ID NO: 51
  Description of Artificial Sequence: Synthetic polypeptide
  2+1 - L1.47_ H1.31 - with Xtend Chain 1

SEQ ID NO: 470 - protein, 489 aa, Artificial Sequence
  Description of Artificial Sequence: Synthetic polypeptide
  2+1 - L1.47_ H1.31 - with Xtend Chain 2
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 471 - protein, 107 aa, Artificial Sequence [sequence omitted]

SEQ ID NO: 472 - protein, 229 aa, Artificial Sequence
  Description of Artificial Sequence: Synthetic polypeptide
  XENP24782 Chain 1 - [aFAP]_H0.9
QVQLVQSGAEVKKPGASVKVSCKTSRYTFTEYTIHWVRQAPGQRLEWMGGINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 473 - protein, 220 aa, Artificial Sequence; identical to SEQ ID NO: 136
  Description of Artificial Sequence: Synthetic polypeptide
  XENP24782 Chain 2 - [aFAP]_L0

SEQ ID NO: 474 - protein, 229 aa, Artificial Sequence
  Description of Artificial Sequence: Synthetic polypeptide
  XENP24783 Chain 1 - [aFAP]_H0.10
QVQLVQSGAEVKKPGASVKVSCKTSRYTFTEYTIHWVRQAPGQRLEWIGWINPNNGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 475 - protein, 220 aa, Artificial Sequence; identical to SEQ ID NO: 136
  Description of Artificial Sequence: Synthetic polypeptide
  XENP24783 Chain 2 - [aFAP]_L0

SEQ ID NO: 476 - protein, 229 aa, Artificial Sequence
  Description of Artificial Sequence: Synthetic polypeptide
  XENP24784 Chain 1 - [aFAP]_H0.11
QVQLVQSGAEVKKPGASVKVSCKTSRYTFTEYTIHWVRQAPGQRLEWIGGINPENGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 477 - protein, 220 aa, Artificial Sequence; identical to SEQ ID NO: 136
  Description of Artificial Sequence: Synthetic polypeptide
  XENP24784 Chain 2 - [aFAP]_L0

SEQ ID NO: 478 - protein, 229 aa, Artificial Sequence
  Description of Artificial Sequence: Synthetic polypeptide
  XENP24785 Chain 1 - [aFAP]_H0.12
QVQLVQSGAEVKKPGASVKVSCKTSRYTFTEYTIHWVRQAPGQRLEWIGGINPNSGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 479 - protein, 220 aa, Artificial Sequence; identical to SEQ ID NO: 136
  Description of Artificial Sequence: Synthetic polypeptide
  XENP24785 Chain 2 - [aFAP]_L0

SEQ ID NO: 480 - protein, 229 aa, Artificial Sequence
  Description of Artificial Sequence: Synthetic polypeptide
  XENP24786 Chain 1 - [aFAP]_H0.13
QVQLVQSGAEVKKPGASVKVSCKTSRYTFTEYTIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 481 - protein, 220 aa, Artificial Sequence; identical to SEQ ID NO: 136
  Description of Artificial Sequence: Synthetic polypeptide
  XENP24786 Chain 2 - [aFAP]_L0

SEQ ID NO: 482 - protein, 229 aa, Artificial Sequence
  Description of Artificial Sequence: Synthetic polypeptide
  XENP24787 Chain 1 - [aFAP]_H0.14
QVQLVQSGAEVKKPGASVKVSCKTSRYTFTEYTIHWVRQAPGQRLEWIGGINPNQGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 483 - protein, 220 aa, Artificial Sequence; identical to SEQ ID NO: 136
  Description of Artificial Sequence: Synthetic polypeptide
  XENP24787 Chain 2 - [aFAP]_L0

SEQ ID NO: 484 - protein, 229 aa, Artificial Sequence
  Description of Artificial Sequence: Synthetic polypeptide
  XENP24788 Chain 1 - [aFAP]_H0.15
QVQLVQSGAEVKKPGASVKVSCKTSRYTFTEYTIHWVRQAPGQRLEWIGGINPNGGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 485 - protein, 220 aa, Artificial Sequence; identical to SEQ ID NO: 136
  Description of Artificial Sequence: Synthetic polypeptide
  XENP24788 Chain 2 - [aFAP]_L0

SEQ ID NO: 486 - protein, 229 aa, Artificial Sequence
  Description of Artificial Sequence: Synthetic polypeptide
  XENP24789 Chain 1 - [aFAP]_H0.16
QVQLVQSGAEVKKPGASVKVSCKTSRYTFTEYTIHWVRQAPGQRLEWIGGINPNNSIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 487 - protein, 220 aa, Artificial Sequence; identical to SEQ ID NO: 136
  Description of Artificial Sequence: Synthetic polypeptide
  XENP24789 Chain 2 - [aFAP]_L0

SEQ ID NO: 488 - protein, 229 aa, Artificial Sequence
  Description of Artificial Sequence: Synthetic polypeptide
  XENP24790 Chain 1 - [aFAP]_H0.17
QVQLVQSGAEVKKPGASVKVSCKTSRYTFTEYTIHWVRQAPGQRLEWIGGINPNGSIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 489 - protein, 220 aa, Artificial Sequence; identical to SEQ ID NO: 136
  Description of Artificial Sequence: Synthetic polypeptide
  XENP24790 Chain 2 - [aFAP]_L0

SEQ ID NO: 490 - protein, 229 aa, Artificial Sequence
  Description of Artificial Sequence: Synthetic polypeptide
  XENP24791 Chain 1 - [aFAP]_H0.18
QVQLVQSGAEVKKPGASVKVSCKTSRYTFTEYTIHWVRQAPGQRLEWIGGINPNNGITNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 491 - protein, 220 aa, Artificial Sequence; identical to SEQ ID NO: 136
  Description of Artificial Sequence: Synthetic polypeptide
  XENP24791 Chain 2 - [aFAP]_L0

SEQ ID NO: 492 - protein, 229 aa, Artificial Sequence
  Description of Artificial Sequence: Synthetic polypeptide
  XENP24792 Chain 1 - [aFAP]_H0.19
QVQLVQSGAEVKKPGASVKVSCKTSRYTFTEYTIHWVRQAPGQRLEWIGGINPNNGIPEYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 493 - protein, 220 aa, Artificial Sequence; identical to SEQ ID NO: 136
  Description of Artificial Sequence: Synthetic polypeptide
  XENP24792 Chain 2 - [aFAP]_L0

SEQ ID NO: 494 - protein, 229 aa, Artificial Sequence
  Description of Artificial Sequence: Synthetic polypeptide
  XENP24793 Chain 1 - [aFAP]_H0.20
QVQLVQSGAEVKKPGASVKVSCKTSRYTFTEYTIHWVRQAPGQRLEWIGGINPNNGIPKYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 495 - protein, 220 aa, Artificial Sequence; identical to SEQ ID NO: 136
  Description of Artificial Sequence: Synthetic polypeptide
  XENP24793 Chain 2 - [aFAP]_L0

SEQ ID NO: 496 - protein, 229 aa, Artificial Sequence
  Description of Artificial Sequence: Synthetic polypeptide
  XENP24794 Chain 1 - [aFAP]_H0.21
QVQLVQSGAEVKKPGASVKVSCKTSRYTFTEYTIHWVRQAPGQRLEWIGGINPNNGIPQYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 497 - protein, 220 aa, Artificial Sequence; identical to SEQ ID NO: 136
  Description of Artificial Sequence: Synthetic polypeptide
  XENP24794 Chain 2 - [aFAP]_L0

SEQ ID NO: 498 - protein, 229 aa, Artificial Sequence
  Description of Artificial Sequence: Synthetic polypeptide
  XENP24795 Chain 1 - [aFAP]_H0.22
QVQLVQSGAEVKKPGASVKVSCKTSRYTFTEYTIHWVRQAPGQRLEWIGGINPNNGIPNYNDKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 499 - protein, 220 aa, Artificial Sequence; identical to SEQ ID NO: 136
  Description of Artificial Sequence: Synthetic polypeptide
  XENP24795 Chain 2 - [aFAP]_L0

SEQ ID NO: 500 - protein, 229 aa, Artificial Sequence
  Description of Artificial Sequence: Synthetic polypeptide
  XENP24796 Chain 1 - [aFAP]_H0.23
QVQLVQSGAEVKKPGASVKVSCKTSRYTFTEYTIHWVRQAPGQRLEWIGGINPNNGIPNYNQKFQGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 501 - protein, 220 aa, Artificial Sequence; identical to SEQ ID NO: 136
  Description of Artificial Sequence: Synthetic polypeptide
  XENP24796 Chain 2 - [aFAP]_L0

SEQ ID NO: 502 - protein, 229 aa, Artificial Sequence
  Description of Artificial Sequence: Synthetic polypeptide
  XENP24801 Chain 1 - [aFAP]_H0.24
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCATRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 503 - protein, 220 aa, Artificial Sequence; identical to SEQ ID NO: 136
  Description of Artificial Sequence: Synthetic polypeptide
  XENP24801 Chain 2 - [aFAP]_L0

SEQ ID NO: 504 - protein, 229 aa, Artificial Sequence
  Description of Artificial Sequence: Synthetic polypeptide
  XENP25264 Chain 1 - [aFAP]_H0.25
QVQLVQSGAEVKKPGASVKVSCKTSRYTFTEYAIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 505 - protein, 220 aa, Artificial Sequence; identical to SEQ ID NO: 136
  Description of Artificial Sequence: Synthetic polypeptide
  XENP25264 Chain 2 - [aFAP]_L0

SEQ ID NO: 506 - protein, 229 aa, Artificial Sequence
  Description of Artificial Sequence: Synthetic polypeptide
  XENP25265 Chain 1 - [aFAP]_H0.26
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 507 - protein, 220 aa, Artificial Sequence; identical to SEQ ID NO: 136
  Description of Artificial Sequence: Synthetic polypeptide
  XENP25265 Chain 2 - [aFAP]_L0

SEQ ID NO: 508 - protein, 229 aa, Artificial Sequence; identical to SEQ ID NO: 382
  Description of Artificial Sequence: Synthetic polypeptide
  XENP27885 Chain 1 - [aFAP]_H0

SEQ ID NO: 509 - protein, 220 aa, Artificial Sequence
  Description of Artificial Sequence: Synthetic polypeptide
  XENP27885 Chain 2 - [aFAP]_L0.1
DIVMTQSPDSLAVSLGERATINCKSSESLLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 510 - protein, 229 aa, Artificial Sequence; identical to SEQ ID NO: 382
  Description of Artificial Sequence: Synthetic polypeptide
  XENP27886 Chain 1 - [aFAP]_H0

SEQ ID NO: 511 - protein, 220 aa, Artificial Sequence
  Description of Artificial Sequence: Synthetic polypeptide
  XENP27886 Chain 2 - [aFAP]_L0.2
DIVMTQSPDSLAVSLGERATINCKSSQTLLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 512 - protein, 229 aa, Artificial Sequence; identical to SEQ ID NO: 382
  Description of Artificial Sequence: Synthetic polypeptide
  XENP27887 Chain 1 - [aFAP]_H0

SEQ ID NO: 513 - protein, 220 aa, Artificial Sequence
  Description of Artificial Sequence: Synthetic polypeptide
  XENP27887 Chain 2 - [aFAP]_L0.3
DIVMTQSPDSLAVSLGERATINCKSSQALLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 514 - protein, 229 aa, Artificial Sequence; identical to SEQ ID NO: 382
  Description of Artificial Sequence: Synthetic polypeptide
  XENP27888 Chain 1 - [aFAP]_H0

SEQ ID NO: 515 - protein, 220 aa, Artificial Sequence
  Description of Artificial Sequence: Synthetic polypeptide
  XENP27888 Chain 2 - [aFAP]_L0.4
DIVMTQSPDSLAVSLGERATINCKSSQSVLYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 516 - protein, 229 aa, Artificial Sequence; identical to SEQ ID NO: 382
  Description of Artificial Sequence: Synthetic polypeptide
  XENP27889 Chain 1 - [aFAP]_H0

SEQ ID NO: 517 - protein, 220 aa, Artificial Sequence
  Description of Artificial Sequence: Synthetic polypeptide
  XENP27889 Chain 2 - [aFAP]_L0.5
DIVMTQSPDSLAVSLGERATINCKSSQSILYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 518 - protein, 229 aa, Artificial Sequence; identical to SEQ ID NO: 382
  Description of Artificial Sequence: Synthetic polypeptide
  XENP27890 Chain 1 - [aFAP]_H0

SEQ ID NO: 519 - protein, 220 aa, Artificial Sequence
  Description of Artificial Sequence: Synthetic polypeptide
  XENP27890 Chain 2 - [aFAP]_L0.6
DIVMTQSPDSLAVSLGERATINCKSSQSLVYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 520 - protein, 229 aa, Artificial Sequence; identical to SEQ ID NO: 382
  Description of Artificial Sequence: Synthetic polypeptide
  XENP27891 Chain 1 - [aFAP]_H0

SEQ ID NO: 521 - protein, 220 aa, Artificial Sequence
  Description of Artificial Sequence: Synthetic polypeptide
  XENP27891 Chain 2 - [aFAP]_L0.7
DIVMTQSPDSLAVSLGERATINCKSSQSLIYSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 522 - protein, 229 aa, Artificial Sequence; identical to SEQ ID NO: 382
  Description of Artificial Sequence: Synthetic polypeptide
  XENP27892 Chain 1 - [aFAP]_H0

SEQ ID NO: 523 - protein, 220 aa, Artificial Sequence
  Description of Artificial Sequence: Synthetic polypeptide
  XENP27892 Chain 2 - [aFAP]_L0.8
DIVMTQSPDSLAVSLGERATINCKSSQSLLFSRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - protein, 229 aa, Artificial Sequence; identical to SEQ ID NO: 382
  Description of Artificial Sequence: Synthetic polypeptide
  XENP27893 Chain 1 - [aFAP]_H0

SEQ ID NO: 525 - protein, 220 aa, Artificial Sequence
  Description of Artificial Sequence: Synthetic polypeptide
  XENP27893 Chain 2 - [aFAP]_L0.9
DIVMTQSPDSLAVSLGERATINCKSSQSLLYTRNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 526 - protein, 229 aa, Artificial Sequence; identical to SEQ ID NO: 382
  Description of Artificial Sequence: Synthetic polypeptide
  XENP27894 Chain 1 - [aFAP]_H0

SEQ ID NO: 527 - protein, 220 aa, Artificial Sequence
  Description of Artificial Sequence: Synthetic polypeptide
  XENP27894 Chain 2 - [aFAP]_L0.10
DIVMTQSPDSLAVSLGERATINCKSSQSLLYARNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 528 - protein, 229 aa, Artificial Sequence; identical to SEQ ID NO: 382
  Description of Artificial Sequence: Synthetic polypeptide
  XENP27895 Chain 1 - [aFAP]_H0

SEQ ID NO: 529 - protein, 220 aa, Artificial Sequence
  Description of Artificial Sequence: Synthetic polypeptide
  XENP27895 Chain 2 - [aFAP]_L0.11
DIVMTQSPDSLAVSLGERATINCKSSQSLLYSSNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 530 - protein, 229 aa, Artificial Sequence; identical to SEQ ID NO: 382
  Description of Artificial Sequence: Synthetic polypeptide
  XENP27896 Chain 1 - [aFAP]_H0

SEQ ID NO: 531 - protein, 220 aa, Artificial Sequence
  Description of Artificial Sequence: Synthetic polypeptide
  XENP27896 Chain 2 - [aFAP]_L0.12
DIVMTQSPDSLAVSLGERATINCKSSQSLLYSHNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 532 - protein, 229 aa, Artificial Sequence; identical to SEQ ID NO: 382
  Description of Artificial Sequence: Synthetic polypeptide
  XENP27897 Chain 1 - [aFAP]_H0

SEQ ID NO: 533 - protein, 220 aa, Artificial Sequence
  Description of Artificial Sequence: Synthetic polypeptide
  XENP27897 Chain 2 - [aFAP]_L0.13
DIVMTQSPDSLAVSLGERATINCKSSQSLLYSQNQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 534 - protein, 229 aa, Artificial Sequence; identical to SEQ ID NO: 382
  Description of Artificial Sequence: Synthetic polypeptide
  XENP27898 Chain 1 - [aFAP]_H0

SEQ ID NO: 535 - protein, 220 aa, Artificial Sequence
  Description of Artificial Sequence: Synthetic polypeptide
  XENP27898 Chain 2 - [aFAP]_L0.14
DIVMTQSPDSLAVSLGERATINCKSSQSLLYSREQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 536 - protein, 229 aa, Artificial Sequence; identical to SEQ ID NO: 382
  Description of Artificial Sequence: Synthetic polypeptide
  XENP27899 Chain 1 - [aFAP]_H0

SEQ ID NO: 537 - protein, 220 aa, Artificial Sequence
  Description of Artificial Sequence: Synthetic polypeptide
  XENP27899 Chain 2 - [aFAP]_L0.15
DIVMTQSPDSLAVSLGERATINCKSSQSLLYSRQQKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 538 - protein, 229 aa, Artificial Sequence; identical to SEQ ID NO: 382
  Description of Artificial Sequence: Synthetic polypeptide
  XENP27900 Chain 1 - [aFAP]_H0

SEQ ID NO: 539 - protein, 220 aa, Artificial Sequence
  Description of Artificial Sequence: Synthetic polypeptide
  XENP27900 Chain 2 - [aFAP]_L0.16
DIVMTQSPDSLAVSLGERATINCKSSQSLLYSRNEKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 229 aa, Artificial Sequence; identical to SEQ ID NO: 382
  Description of Artificial Sequence: Synthetic polypeptide
  XENP27901 Chain 1 - [aFAP]_H0

SEQ ID NO: 541 - protein, 220 aa, Artificial Sequence
  Description of Artificial Sequence: Synthetic polypeptide
  XENP27901 Chain 2 - [aFAP]_L0.17
DIVMTQSPDSLAVSLGERATINCKSSQSLLYSRNNKNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 229 aa, Artificial Sequence; identical to SEQ ID NO: 382
  Description of Artificial Sequence: Synthetic polypeptide
  XENP27902 Chain 1 - [aFAP]_H0

SEQ ID NO: 543 - protein, 220 aa, Artificial Sequence
  Description of Artificial Sequence: Synthetic polypeptide
  XENP27902 Chain 2 - [aFAP]_L0.18
DIVMTQSPDSLAVSLGERATINCKSSQSLLYSRNQQNYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 544 - protein, 229 aa, Artificial Sequence; identical to SEQ ID NO: 382
  Description of Artificial Sequence: Synthetic polypeptide
  XENP27903 Chain 1 - [aFAP]_H0

SEQ ID NO: 545 - protein, 220 aa, Artificial Sequence
  Description of Artificial Sequence: Synthetic polypeptide
  XENP27903 Chain 2 - [aFAP]_L0.19
DIVMTQSPDSLAVSLGERATINCKSSQSLLYSRNQENYLAWYQQKPGQPPKLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 546 - protein, 229 aa, Artificial Sequence; identical to SEQ ID NO: 382
  Description of Artificial Sequence: Synthetic polypeptide
  XENP27904 Chain 1 - [aFAP]_H0

SEQ ID NO: 547 - protein, 220 aa, Artificial Sequence
  Description of Artificial Sequence: Synthetic polypeptide
  XENP27904 Chain 2 - [aFAP]_L0.20
DIVMTQSPDSLAVSLGERATINCKSSQSLLYSRNQKNYLAWYQQKPGQPPRLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 548 - protein, 229 aa, Artificial Sequence; identical to SEQ ID NO: 382
  Description of Artificial Sequence: Synthetic polypeptide
  XENP27905 Chain 1 - [aFAP]_H0

SEQ ID NO: 549 - protein, 220 aa, Artificial Sequence
  Description of Artificial Sequence: Synthetic polypeptide
  XENP27905 Chain 2 - [aFAP]_L0.21
DIVMTQSPDSLAVSLGERATINCKSSQSLLYSRNQKNYLAWYQQKPGQPPQLLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 550 - protein, 229 aa, Artificial Sequence; identical to SEQ ID NO: 382
  Description of Artificial Sequence: Synthetic polypeptide
  XENP27906 Chain 1 - [aFAP]_H0

SEQ ID NO: 551 - protein, 220 aa, Artificial Sequence
  Description of Artificial Sequence: Synthetic polypeptide
  XENP27906 Chain 2 - [aFAP]_L0.22
DIVMTQSPDSLAVSLGERATINCKSSQSLLYSRNQKNYLAWYQQKPGQPPELLIFWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 552 - protein, 229 aa, Artificial Sequence; identical to SEQ ID NO: 382
  Description of Artificial Sequence: Synthetic polypeptide
  XENP27907 Chain 1 - [aFAP]_H0

SEQ ID NO: 553 - protein, 220 aa, Artificial Sequence
  Description of Artificial Sequence: Synthetic polypeptide
  XENP27907 Chain 2 - [aFAP]_L0.23
DIVMTQSPDSLAVSLGERATINCKSSQSLLYSRNQKNYLAWYQQKPGQPPKLLIYWASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 554 - protein, 229 aa, Artificial Sequence; identical to SEQ ID NO: 382
  Description of Artificial Sequence: Synthetic polypeptide
  XENP27908 Chain 1 - [aFAP]_H0

SEQ ID NO: 555 - protein, 220 aa, Artificial Sequence
  Description of Artificial Sequence: Synthetic polypeptide
  XENP27908 Chain 2 - [aFAP]_L0.24
DIVMTQSPDSLAVSLGERATINCKSSQSLLYSRNQKNYLAWYQQKPGQPPKLLIFFASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 556 - protein, 229 aa, Artificial Sequence; identical to SEQ ID NO: 382
  Description of Artificial Sequence: Synthetic polypeptide
  XENP27909 Chain 1 - [aFAP]_H0

SEQ ID NO: 557 - protein, 220 aa, Artificial Sequence
  Description of Artificial Sequence: Synthetic polypeptide
  XENP27909 Chain 2 - [aFAP]_L0.25
DIVMTQSPDSLAVSLGERATINCKSSQSLLYSRNQKNYLAWYQQKPGQPPKLLIFYASTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 558 - protein, 229 aa, Artificial Sequence; identical to SEQ ID NO: 382
  Description of Artificial Sequence: Synthetic polypeptide
  XENP27910 Chain 1 - [aFAP]_H0

SEQ ID NO: 559 - protein, 220 aa, Artificial Sequence
  Description of Artificial Sequence: Synthetic polypeptide
  XENP27910 Chain 2 - [aFAP]_L0.26
DIVMTQSPDSLAVSLGERATINCKSSQSLLYSRNQKNYLAWYQQKPGQPPKLLIFWTSTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 560 - protein, 229 aa, Artificial Sequence; identical to SEQ ID NO: 382
  Description of Artificial Sequence: Synthetic polypeptide
  XENP27911 Chain 1 - [aFAP]_H0

SEQ ID NO: 561 - protein, 220 aa, Artificial Sequence
  Description of Artificial Sequence: Synthetic polypeptide
  XENP27911 Chain 2 - [aFAP]_L0.27
DIVMTQSPDSLAVSLGERATINCKSSQSLLYSRNQKNYLAWYQQKPGQPPKLLIFWSSTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 562 - protein, 229 aa, Artificial Sequence; identical to SEQ ID NO: 382
  Description of Artificial Sequence: Synthetic polypeptide
  XENP27912 Chain 1 - [aFAP]_H0

SEQ ID NO: 563 - protein, 220 aa, Artificial Sequence
  Description of Artificial Sequence: Synthetic polypeptide
  XENP27912 Chain 2 - [aFAP]_L0.28
DIVMTQSPDSLAVSLGERATINCKSSQSLLYSRNQKNYLAWYQQKPGQPPKLLIFWATTRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 564 - protein, 229 aa, Artificial Sequence; identical to SEQ ID NO: 382
  Description of Artificial Sequence: Synthetic polypeptide
  XENP27913 Chain 1 - [aFAP]_H0

SEQ ID NO: 565 - protein, 220 aa, Artificial Sequence
  Description of Artificial Sequence: Synthetic polypeptide
  XENP27913 Chain 2 - [aFAP]_L0.29
DIVMTQSPDSLAVSLGERATINCKSSQSLLYSRNQKNYLAWYQQKPGQPPKLLIFWAATRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 229 aa, Artificial Sequence; identical to SEQ ID NO: 382
  Description of Artificial Sequence: Synthetic polypeptide
  XENP27914 Chain 1 - [aFAP]_H0

SEQ ID NO: 567 - protein, 220 aa, Artificial Sequence
  Description of Artificial Sequence: Synthetic polypeptide
  XENP27914 Chain 2 - [aFAP]_L0.30
DIVMTQSPDSLAVSLGERATINCKSSQSLLYSRNQKNYLAWYQQKPGQPPKLLIFWASVRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 568 - protein, 229 aa, Artificial Sequence; identical to SEQ ID NO: 382
  Description of Artificial Sequence: Synthetic polypeptide
  XENP27915 Chain 1 - [aFAP]_H0

SEQ ID NO: 569 - protein, 220 aa, Artificial Sequence
  Description of Artificial Sequence: Synthetic polypeptide
  XENP27915 Chain 2 - [aFAP]_L0.31
DIVMTQSPDSLAVSLGERATINCKSSQSLLYSRNQKNYLAWYQQKPGQPPKLLIFWASIRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 570 - protein, 229 aa, Artificial Sequence; identical to SEQ ID NO: 382
  Description of Artificial Sequence: Synthetic polypeptide
  XENP27916 Chain 1 - [aFAP]_H0

SEQ ID NO: 571 - protein, 220 aa, Artificial Sequence
  Description of Artificial Sequence: Synthetic polypeptide
  XENP27916 Chain 2 - [aFAP]_L0.32
DIVMTQSPDSLAVSLGERATINCKSSQSLLYSRNQKNYLAWYQQKPGQPPKLLIFWASLRESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 572 - protein, 229 aa, Artificial Sequence; identical to SEQ ID NO: 382
  Description of Artificial Sequence: Synthetic polypeptide
  XENP27917 Chain 1 - [aFAP]_H0

SEQ ID NO: 573 - protein, 220 aa, Artificial Sequence
  Description of Artificial Sequence: Synthetic polypeptide
  XENP27917 Chain 2 - [aFAP]_L0.33
DIVMTQSPDSLAVSLGERATINCKSSQSLLYSRNQKNYLAWYQQKPGQPPKLLIFWASTHESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 574 - protein, 229 aa, Artificial Sequence; identical to SEQ ID NO: 382
  Description of Artificial Sequence: Synthetic polypeptide
  XENP27918 Chain 1 - [aFAP]_H0

SEQ ID NO: 575 - protein, 220 aa, Artificial Sequence
  Description of Artificial Sequence: Synthetic polypeptide
  XENP27918 Chain 2 - [aFAP]_L0.34
DIVMTQSPDSLAVSLGERATINCKSSQSLLYSRNQKNYLAWYQQKPGQPPKLLIFWASTKESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 576 - protein, 229 aa, Artificial Sequence; identical to SEQ ID NO: 382
  Description of Artificial Sequence: Synthetic polypeptide
  XENP27919 Chain 1 - [aFAP]_H0

SEQ ID NO: 577 - protein, 220 aa, Artificial Sequence
  Description of Artificial Sequence: Synthetic polypeptide
  XENP27919 Chain 2 - [aFAP]_L0.35
DIVMTQSPDSLAVSLGERATINCKSSQSLLYSRNQKNYLAWYQQKPGQPPKLLIFWASTEESGVPDRFSGSGFGTDFTLTISSLQAEDVAVYYCQQYFSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 578 - protein, 229 aa, Artificial Sequence; identical to SEQ ID NO: 382
  Description of Artificial Sequence: Synthetic polypeptide
  XENP27920 Chain 1 - [aFAP]_H0

SEQ ID NO: 579 - protein, 220 aa, Artificial Sequence
  Description of Artificial Sequence: Synthetic polypeptide
  XENP27920 Chain 2 - [aFAP]_L0.36
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYYSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 580 - protein, 229 aa, Artificial Sequence; identical to SEQ ID NO: 382
  Description of Artificial Sequence: Synthetic polypeptide
  XENP27921 Chain 1 - [aFAP]_H0

SEQ ID NO: 581 - protein, 220 aa, Artificial Sequence
  Description of Artificial Sequence: Synthetic polypeptide
  XENP27921 Chain 2 - [aFAP]_L0.37
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFTYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 229 aa, Artificial Sequence; identical to SEQ ID NO: 382
  Description of Artificial Sequence: Synthetic polypeptide
  XENP27922 Chain 1 - [aFAP]_H0

SEQ ID NO: 583 - protein, 220 aa, Artificial Sequence
  Description of Artificial Sequence: Synthetic polypeptide
  XENP27922 Chain 2 - [aFAP]_L0.38
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFAYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 584 - protein, 229 aa, Artificial Sequence; identical to SEQ ID NO: 382
  Description of Artificial Sequence: Synthetic polypeptide
  XENP27923 Chain 1 - [aFAP]_H0

SEQ ID NO: 585 - protein, 220 aa, Artificial Sequence
  Description of Artificial Sequence: Synthetic polypeptide
  XENP27923 Chain 2 - [aFAP]_L0.39
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 586 - protein, 229 aa, Artificial Sequence; identical to SEQ ID NO: 382
  Description of Artificial Sequence: Synthetic polypeptide
  XENP27924 Chain 1 - [aFAP]_H0

SEQ ID NO: 587 - protein, 220 aa, Artificial Sequence
  Description of Artificial Sequence: Synthetic polypeptide
  XENP27924 Chain 2 - [aFAP]_L0.40
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSFPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 588 - protein, 229 aa, Artificial Sequence; identical to SEQ ID NO: 382
  Description of Artificial Sequence: Synthetic polypeptide
  XENP27925 Chain 1 - [aFAP]_H0

SEQ ID NO: 589 - protein, 220 aa, Artificial Sequence
  Description of Artificial Sequence: Synthetic polypeptide
  XENP27925 Chain 2 - [aFAP]_L0.41
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 590 - protein, 229 aa, Artificial Sequence; identical to SEQ ID NO: 382
  Description of Artificial Sequence: Synthetic polypeptide
  XENP27926 Chain 1 - [aFAP]_H0

SEQ ID NO: 591 - protein, 220 aa, Artificial Sequence
  Description of Artificial Sequence: Synthetic polypeptide
  XENP27926 Chain 2 - [aFAP]_L0.42
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 592 - protein, 229 aa, Artificial Sequence; identical to SEQ ID NO: 382
  Description of Artificial Sequence: Synthetic polypeptide
  XENP27927 Chain 1 - [aFAP]_H0

SEQ ID NO: 593 - protein, 220 aa, Artificial Sequence
  Description of Artificial Sequence: Synthetic polypeptide
  XENP27927 Chain 2 - [aFAP]_L0.43
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 594 - protein, 229 aa, Artificial Sequence; identical to SEQ ID NO: 382
  Description of Artificial Sequence: Synthetic polypeptide
  XENP27928 Chain 1 - [aFAP]_H0

SEQ ID NO: 595 - protein, 220 aa, Artificial Sequence
  Description of Artificial Sequence: Synthetic polypeptide
  XENP27928 Chain 2 - [aFAP]_L0.45
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLVFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 596 - protein, 229 aa, Artificial Sequence; identical to SEQ ID NO: 382
  Description of Artificial Sequence: Synthetic polypeptide
  XENP27929 Chain 1 - [aFAP]_H0

SEQ ID NO: 597 - protein, 214 aa, Artificial Sequence; identical to SEQ ID NO: 260
  Description of Artificial Sequence: Synthetic polypeptide
  XENP27929 Chain 2 - [aFAP]_L1(CLC)

SEQ ID NO: 598 - protein, 229 aa, Artificial Sequence; identical to SEQ ID NO: 480
  Description of Artificial Sequence: Synthetic polypeptide
  XENP27964 Chain 1 - [aFAP]_H0.13

SEQ ID NO: 599 - protein, 220 aa, Artificial Sequence; identical to SEQ ID NO: 529
  Description of Artificial Sequence: Synthetic polypeptide
  XENP27964 Chain 2 - [aFAP]_L0.11

SEQ ID NO: 600 - protein, 229 aa, Artificial Sequence; identical to SEQ ID NO: 480
  Description of Artificial Sequence: Synthetic polypeptide
  XENP27965 Chain 1 - [aFAP]_H0.13

SEQ ID NO: 601 - protein, 220 aa, Artificial Sequence; identical to SEQ ID NO: 535
  Description of Artificial Sequence: Synthetic polypeptide
  XENP27965 Chain 2 - [aFAP]_L0.14

SEQ ID NO: 602 - protein, 229 aa, Artificial Sequence; identical to SEQ ID NO: 480
  Description of Artificial Sequence: Synthetic polypeptide
  XENP27966 Chain 1 - [aFAP]_H0.13

SEQ ID NO: 603 - protein, 220 aa, Artificial Sequence; identical to SEQ ID NO: 545
  Description of Artificial Sequence: Synthetic polypeptide
  XENP27966 Chain 2 - [aFAP]_L0.19

SEQ ID NO: 604 - protein, 229 aa, Artificial Sequence; identical to SEQ ID NO: 480
  Description of Artificial Sequence: Synthetic polypeptide
  XENP27967 Chain 1 - [aFAP]_H0.13

SEQ ID NO: 605 - protein, 220 aa, Artificial Sequence; identical to SEQ ID NO: 589
  Description of Artificial Sequence: Synthetic polypeptide
  XENP27967 Chain 2 - [aFAP]_L0.41

SEQ ID NO: 606 - protein, 229 aa, Artificial Sequence; identical to SEQ ID NO: 506
  Description of Artificial Sequence: Synthetic polypeptide
  XENP27968 Chain 1 - [aFAP]_H0.26

SEQ ID NO: 607 - protein, 220 aa, Artificial Sequence; identical to SEQ ID NO: 529
  Description of Artificial Sequence: Synthetic polypeptide
  XENP27968 Chain 2 - [aFAP]_L0.11

SEQ ID NO: 608 - protein, 229 aa, Artificial Sequence; identical to SEQ ID NO: 506
  Description of Artificial Sequence: Synthetic polypeptide
  XENP27969 Chain 1 - [aFAP]_H0.26

SEQ ID NO: 609 - protein, 220 aa, Artificial Sequence; identical to SEQ ID NO: 535
  Description of Artificial Sequence: Synthetic polypeptide
  XENP27969 Chain 2 - [aFAP]_L0.14

SEQ ID NO: 610 - protein, 229 aa, Artificial Sequence; identical to SEQ ID NO: 506
  Description of Artificial Sequence: Synthetic polypeptide
  XENP27970 Chain 1 - [aFAP]_H0.26

SEQ ID NO: 611 - protein, 220 aa, Artificial Sequence; identical to SEQ ID NO: 545
  Description of Artificial Sequence: Synthetic polypeptide
  XENP27970 Chain 2 - [aFAP]_L0.19

SEQ ID NO: 612 - protein, 229 aa, Artificial Sequence; identical to SEQ ID NO: 506
  Description of Artificial Sequence: Synthetic polypeptide
  XENP27971 Chain 1 - [aFAP]_H0.26

SEQ ID NO: 613 - protein, 220 aa, Artificial Sequence; identical to SEQ ID NO: 589
  Description of Artificial Sequence: Synthetic polypeptide
  XENP27971 Chain 2 - [aFAP]_L0.41

SEQ ID NO: 614 - protein, 1013 aa, Artificial Sequence
  Description of Artificial Sequence: Synthetic polypeptide
  XENP22476_His-Avi_hFc-Tev-huFAP
HHHHHHGGGGSGLNDIFEAQKIEWHEGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSENLYFQGGGGGSIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 615 - protein, 453 aa, Artificial Sequence
  Description of Artificial Sequence: Synthetic polypeptide
  XENP25388 Monomer 1 - [aFAP]_H0.13_IgG1_PVA_/S267K-pI(-) _Isosteric_A_L368D/K370S
QVQLVQSGAEVKKPGASVKVSCKTSRYTFTEYTIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 616 - protein, 726 aa, Artificial Sequence
  Description of Artificial Sequence: Synthetic polypeptide
  XENP25388 Monomer 2 - [aFAP]_H0.13_[aCD3]_H1.30_L1.47 _scFv(GKPGS)4_(G4S)2_IgG1_C220S/S364K/E357Q
QVQLVQSGAEVKKPGASVKVSCKTSRYTFTEYTIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 220 aa, Artificial Sequence; identical to SEQ ID NO: 136
  Description of Artificial Sequence: Synthetic polypeptide
  XENP25388 Monomer 3 - [aFAP]_L0

SEQ ID NO: 618 - protein, 453 aa, Artificial Sequence
  Description of Artificial Sequence: Synthetic polypeptide
  XENP25389 Monomer 1 - Chain 1 - [aFAP]_H0.25_IgG1_PVA _/S267K-pI(-)_Isosteric_A_L368D/K370S
QVQLVQSGAEVKKPGASVKVSCKTSRYTFTEYAIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 619 - protein, 726 aa, Artificial Sequence
  Description of Artificial Sequence: Synthetic polypeptide
  XENP25389 Monomer 2 - [aFAP]_H0.25_[aCD3]_H1.30_L1.47 _scFv(GKPGS)4_(G4S)2_IgG1_C220S/S364K/E357Q
QVQLVQSGAEVKKPGASVKVSCKTSRYTFTEYAIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 220 aa, Artificial Sequence; identical to SEQ ID NO: 136
  Description of Artificial Sequence: Synthetic polypeptide
  XENP25389 Monomer 3 - [aFAP]_L0

SEQ ID NO: 621 - protein, 453 aa, Artificial Sequence
  Description of Artificial Sequence: Synthetic polypeptide
  XENP25390 Monomer 1 - [aFAP]_H0.26_IgG1_PVA_/S267K-pI(-) _Isosteric_A_L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 622 - protein, 726 aa, Artificial Sequence
  Description of Artificial Sequence: Synthetic polypeptide
  XENP25390 Monomer 2 - [aFAP]_H0.26_[aCD3]_H1.30_L1.47 _scFv(GKPGS)4_(G4S)2_IgG1_C220S/S364K/E357Q
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 220 aa, Artificial Sequence; identical to SEQ ID NO: 136
  Description of Artificial Sequence: Synthetic polypeptide
  XENP25390 Monomer 3 - [aFAP]_L0

SEQ ID NO: 624 - protein, 453 aa, Artificial Sequence; identical to SEQ ID NO: 615
  Description of Artificial Sequence: Synthetic polypeptide
  XENP25391 Monomer 1 - [aFAP]_H0.13_IgG1_PVA_/S267K-pI(-) _Isosteric_A_L368D/K370S

SEQ ID NO: 625 - protein, 726 aa, Artificial Sequence
  Description of Artificial Sequence: Synthetic polypeptide
  XENP25391 Monomer 2 - [aFAP]_H0.13_[aCD3]_H1.32_L1.47 _scFv(GKPGS)4_(G4S)2_IgG1_C220S/S364K/E357Q
QVQLVQSGAEVKKPGASVKVSCKTSRYTFTEYTIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 220 aa, Artificial Sequence; identical to SEQ ID NO: 136
  Description of Artificial Sequence: Synthetic polypeptide
  XENP25391 Monomer 3 - [aFAP]_L0

SEQ ID NO: 627 - protein, 453 aa, Artificial Sequence; identical to SEQ ID NO: 618
  Description of Artificial Sequence: Synthetic polypeptide
  XENP25392 Monomer 1 - [aFAP]_H0.25_IgG1_PVA_/S267K-pI(-) _Isosteric_A_L368D/K370S

SEQ ID NO: 628 - protein, 726 aa, Artificial Sequence
  Description of Artificial Sequence: Synthetic polypeptide
  XENP25392 Monomer 2 - [aFAP]_H0.25_[aCD3]_H1.32_L1.47 _scFv(GKPGS)4_(G4S)2_IgG1_C220S/S364K/E357Q
QVQLVQSGAEVKKPGASVKVSCKTSRYTFTEYAIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 629 - protein, 220 aa, Artificial Sequence; identical to SEQ ID NO: 136
  Description of Artificial Sequence: Synthetic polypeptide
  XENP25392 Monomer 3 - [aFAP]_L0

SEQ ID NO: 630 - protein, 453 aa, Artificial Sequence; identical to SEQ ID NO: 621
  Description of Artificial Sequence: Synthetic polypeptide
  XENP25393 Monomer 1 - [aFAP]_H0.26_IgG1_PVA_/S267K-pI(-) _Isosteric_A_L368D/K370S

SEQ ID NO: 631 - protein, 726 aa, Artificial Sequence
  Description of Artificial Sequence: Synthetic polypeptide
  XENP25393 Monomer 2 - [aFAP]_H0.26_[aCD3]_H1.32_L1.47 _scFv(GKPGS)4_(G4S)2_IgG1_C220S/S364K/E357Q
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 632 - protein, 220 aa, Artificial Sequence; identical to SEQ ID NO: 136
  Description of Artificial Sequence: Synthetic polypeptide
  XENP25393 Monomer 3 - [aFAP]_L0

SEQ ID NO: 633 - protein, 453 aa, Artificial Sequence; identical to SEQ ID NO: 615
  Description of Artificial Sequence: Synthetic polypeptide
  XENP28114 Monomer 1 - [aFAP]_H0.13_IgG1_PVA_/S267K_pI(-) _Isosteric_A_L368D/K370S

SEQ ID NO: 634 - protein, 726 aa, Artificial Sequence; identical to SEQ ID NO: 625
  Description of Artificial Sequence: Synthetic polypeptide
  XENP28114 Monomer 2 - [aFAP]_H0.13_[aCD3]_H1.32_L1.47 _scFv(GKPGS)4_(G4S)2_IgG1_C220S/S364K/E357Q

SEQ ID NO: 635 - protein, 220 aa, Artificial Sequence; identical to SEQ ID NO: 545
  Description of Artificial Sequence: Synthetic polypeptide
  XENP28114 Monomer 3 - [aFAP]_L0.19

SEQ ID NO: 636 - protein, 453 aa, Artificial Sequence; identical to SEQ ID NO: 621
  Description of Artificial Sequence: Synthetic polypeptide
  XENP28115 Monomer 1 - [aFAP]_H0.26_IgG1_PVA_/S267K_pI(-) _Isosteric_A_L368D/K370S

SEQ ID NO: 637 - protein, 726 aa, Artificial Sequence; identical to SEQ ID NO: 631
  Description of Artificial Sequence: Synthetic polypeptide
  XENP28115 Monomer 2 - [aFAP]_H0.26_[aCD3]_H1.32_L1.47 _scFv(GKPGS)4_(G4S)2_IgG1_C220S/S364K/E357Q

SEQ ID NO: 638 - protein, 220 aa, Artificial Sequence; identical to SEQ ID NO: 545
  Description of Artificial Sequence: Synthetic polypeptide
  XENP28115 Monomer 3 - [aFAP]_L0.19

SEQ ID NO: 639 - protein, 453 aa, Artificial Sequence; identical to SEQ ID NO: 621
  Description of Artificial Sequence: Synthetic polypeptide
  XENP28116 Monomer 1 - [aFAP]_H0.26_IgG1_PVA_/S267K_pI(-) _Isosteric_A_L368D/K370S

SEQ ID NO: 640 - protein, 726 aa, Artificial Sequence; identical to SEQ ID NO: 631
  Description of Artificial Sequence: Synthetic polypeptide
  XENP28116 Monomer 2 - [aFAP]_H0.26_[aCD3]_H1.32_L1.47 _scFv(GKPGS)4_(G4S)2_IgG1_C220S/S364K/E357Q

SEQ ID NO: 641 - protein, 220 aa, Artificial Sequence; identical to SEQ ID NO: 529
  Description of Artificial Sequence: Synthetic polypeptide
  XENP28116 Monomer 3 - [aFAP]_L0.11

SEQ ID NO: 642 - protein, 453 aa, Artificial Sequence; identical to SEQ ID NO: 621
  Description of Artificial Sequence: Synthetic polypeptide
  XENP28117 Monomer 1 - [aFAP]_H0.26_IgG1_PVA_/S267K_pI(-) _Isosteric_A_L368D/K370S

SEQ ID NO: 643 - protein, 726 aa, Artificial Sequence; identical to SEQ ID NO: 622
  Description of Artificial Sequence: Synthetic polypeptide
  XENP28117 Monomer 2 - [aFAP]_H0.26_[aCD3]_H1.30_L1.47 _scFv(GKPGS)4_(G4S)2_IgG1_C220S/S364K/E357Q

SEQ ID NO: 644 - protein, 220 aa, Artificial Sequence; identical to SEQ ID NO: 545
  Description of Artificial Sequence: Synthetic polypeptide
  XENP28117 Monomer 3 - [aFAP]_L0.19

SEQ ID NO: 645 - protein, 453 aa, Artificial Sequence; identical to SEQ ID NO: 621
  Description of Artificial Sequence: Synthetic polypeptide
  XENP28118 Monomer 1 - [aFAP]_H0.26_IgG1_PVA_/S267K_pI(-) _Isosteric_A_L368D/K370S

SEQ ID NO: 646 - protein, 726 aa, Artificial Sequence; identical to SEQ ID NO: 622
  Description of Artificial Sequence: Synthetic polypeptide
  XENP28118 Monomer 2 - [aFAP]_H0.26_[aCD3]_H1.30_L1.47 _scFv(GKPGS)4_(G4S)2_IgG1_C220S/S364K/E357Q

SEQ ID NO: 647 - protein, 220 aa, Artificial Sequence; identical to SEQ ID NO: 529
  Description of Artificial Sequence: Synthetic polypeptide
  XENP28118 Monomer 3 - [aFAP]_L0.11

SEQ ID NO: 648 - protein, 750 aa, Artificial Sequence
  Description of Artificial Sequence: Synthetic polypeptide
  XENP24370_huFAP_6xLys_6xHis
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGSKKKKKKGSHHHHHH

SEQ ID NO: 649 - protein, 453 aa, Artificial Sequence
  Description of Artificial Sequence: Synthetic polypeptide
  XENP29140 Monomer 1 - [aFAP]_H0.26_IgG1_PVA_/S267K_pI(-) _Isosteric_A_L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 650 - protein, 726 aa, Artificial Sequence
  Description of Artificial Sequence: Synthetic polypeptide
  XENP29140 Monomer 2 - [aFAP]_H0.26_[aCD3]_H1.32_L1.47 _scFv(GKPGS)4_(G4S)2_IgG1_C220S/S364K/E357Q/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 651 - protein, 220 aa, Artificial Sequence; identical to SEQ ID NO: 136
  Description of Artificial Sequence: Synthetic polypeptide
  XENP29140 Monomer 3 - [aFAP]_L0

SEQ ID NO: 652 - protein, 453 aa, Artificial Sequence; identical to SEQ ID NO: 649
  Description of Artificial Sequence: Synthetic polypeptide
  XENP29141 Monomer 1 - [aFAP]_H0.26_IgG1_PVA_/S267K_pI(-) _Isosteric_A_L368D/K370S/M428L/N434S

SEQ ID NO: 653 - protein, 726 aa, Artificial Sequence; identical to SEQ ID NO: 650
  Description of Artificial Sequence: Synthetic polypeptide
  XENP29141 Monomer 2 - [aFAP]_H0.26_[aCD3]_H1.32_L1.47 _scFv(GKPGS)4_(G4S)2_IgG1_C220S/S364K/E357Q/M428L/N434S

SEQ ID NO: 654 - protein, 220 aa, Artificial Sequence; identical to SEQ ID NO: 545
  Description of Artificial Sequence: Synthetic polypeptide
  XENP29141 Monomer 3 - [aFAP]_L0.19

SEQ ID NO: 655 - protein, 453 aa, Artificial Sequence; identical to SEQ ID NO: 649
  Description of Artificial Sequence: Synthetic polypeptide
  XENP29142 Monomer 1 - [aFAP]_H0.26_IgG1_PVA_/S267K_pI(-) _Isosteric_A_L368D/K370S/M428L/N434S

SEQ ID NO: 656 - protein, 726 aa, Artificial Sequence; identical to SEQ ID NO: 650
  Description of Artificial Sequence: Synthetic polypeptide
  XENP29142 Monomer 2 - [aFAP]_H0.26_[aCD3]_H1.32_L1.47 _scFv(GKPGS)4_(G4S)2_IgG1_C220S/S364K/E357Q/M428L/N434S

SEQ ID NO: 657 - protein, 220 aa, Artificial Sequence; identical to SEQ ID NO: 529
  Description of Artificial Sequence: Synthetic polypeptide
  XENP29142 Monomer 3 - [aFAP]_L0.11

SEQ ID NO: 658 - protein, 450 aa, Artificial Sequence
  Description of Artificial Sequence: Synthetic polypeptide
  XENC1000 Monomer 1 - 1F4B5[FAP]_H1L1_IgG1_PVA_/S267K-pI(-) _Isosteric_A_L368D/K370S/M428L/N434S Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 659 - protein, 723 aa, Artificial Sequence
  Description of Artificial Sequence: Synthetic polypeptide
  XENC1000 Monomer 2 - 1F4B5[FAP]_H1L1_Fab_(G4S)2_[ANTI-CD3] _H1.32_L1.47_scFv(GKPGS)4_(G4S)2_IgG1 _C220S/S364K/E357Q/M428L/N434S Fab-scFv-Fc Heavy Chain
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 660 - protein, 214 aa, Artificial Sequence; identical to SEQ ID NO: 260
  Description of Artificial Sequence: Synthetic polypeptide
  XENC1000 Monomer 3 - 1F4B5[FAP]_L1 Light Chain

SEQ ID NO: 661 - protein, 450 aa, Artificial Sequence
  Description of Artificial Sequence: Synthetic polypeptide
  XENC1001 Monomer 1 - 1E5A5(commonLC)[FAP]_H1L1_IgG1_PVA _/S267K-pI(-)_Isosteric_A_L368D/K370S/M428L/N434S Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 662 - protein, 723 aa, Artificial Sequence
  Description of Artificial Sequence: Synthetic polypeptide
  XENC1001 Monomer 2 - 1E5A5(commonLC)[FAP]_H1L1_Fab_(G4S)2 _[ANTI-CD3]_H1.32_L1.47_scFv(GKPGS)4_(G4S)2_IgG1 _C220S/S364K/E357Q/M428L/N434S Fab-scFv-Fc Heavy Chain
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 663 - protein, 214 aa, Artificial Sequence; identical to SEQ ID NO: 260
  Description of Artificial Sequence: Synthetic polypeptide
  XENC1001 Monomer 3 - 1E5A5(commonLC)[FAP]_L1 Light Chain

SEQ ID NO: 664 - protein, 450 aa, Artificial Sequence
  Description of Artificial Sequence: Synthetic polypeptide
  XENC1002 Monomer 1 - 1A7B5[FAP]_H1L1_IgG1_PVA_/S267K-pI(-) _Isosteric_A_L368D/K370S/M428L/N434S Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 665 - protein, 723 aa, Artificial Sequence
  Description of Artificial Sequence: Synthetic polypeptide
  XENC1002 Monomer 2 - 1A7B5[FAP]_H1L1_Fab_(G4S)2_[ANTI-CD3] _H1.32_L1.47_scFv(GKPGS)4_(G4S)2_IgG1 _C220S/S364K/E357Q/M428L/N434S Fab-scFv-Fc Heavy Chain
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 666 - protein, 214 aa, Artificial Sequence; identical to SEQ ID NO: 260
  Description of Artificial Sequence: Synthetic polypeptide
  XENC1002 Monomer 3 - 1A7B5[FAP]_L1 Light Chain

SEQ ID NO: 667 - protein, 450 aa, Artificial Sequence; identical to SEQ ID NO: 661
  Description of Artificial Sequence: Synthetic polypeptide
  XENC1004 Monomer 1 - 1E5A5[FAP]_H1L1_IgG1_PVA_/S267K-pI(-) _Isosteric_A_L368D/K370S/M428L/N434S Heavy Chain

SEQ ID NO: 668 - protein, 723 aa, Artificial Sequence; identical to SEQ ID NO: 662
  Description of Artificial Sequence: Synthetic polypeptide
  XENC1004 Monomer 2 -  1E5A5[FAP]_H1L1_Fab_(G4S)2_[ANTI-CD3] _H1.32_L1.47_scFv(GKPGS)4_(G4S)2_IgG1 _C220S/S364K/E357Q/M428L/N434S Fab-scFv-Fc Heavy Chain

SEQ ID NO: 669 - protein, 214 aa, Artificial Sequence; identical to SEQ ID NO: 258
  Description of Artificial Sequence: Synthetic polypeptide
  XENC1004 Monomer 3 -  1E5A5[FAP]_L1 Light Chain

SEQ ID NO: 670 - protein, 453 aa, Artificial Sequence; identical to SEQ ID NO: 621
  Description of Artificial Sequence: Synthetic polypeptide
  XENP25390 Chain 1 - [alphaFAP]_H0.26_IgG1_C220S/S364K/E357Q

SEQ ID NO: 671 - protein, 623 aa, Artificial Sequence
  Description of Artificial Sequence: Synthetic polypeptide
  XENP25390 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 220 aa, Artificial Sequence; identical to SEQ ID NO: 136
  Description of Artificial Sequence: Synthetic polypeptide
  XENP25390 Chain 3 - [alphaFAP]_L0

SEQ ID NO: 673 - protein, 453 aa, Artificial Sequence; identical to SEQ ID NO: 621
  Description of Artificial Sequence: Synthetic polypeptide
  XENP25393 Chain 1 - [alphaFAP]_H0.26_IgG1_C220S/S364K/E357Q

SEQ ID NO: 674 - protein, 623 aa, Artificial Sequence
  Description of Artificial Sequence: Synthetic polypeptide
  XENP25393 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 220 aa, Artificial Sequence; identical to SEQ ID NO: 136
  Description of Artificial Sequence: Synthetic polypeptide
  XENP25393 Chain 3 - [alphaFAP]_L0

SEQ ID NO: 676 - protein, 453 aa, Artificial Sequence; identical to SEQ ID NO: 621
  Description of Artificial Sequence: Synthetic polypeptide
  XENC1005 Chain 1 - [alphaFAP]_H0.26_IgG1_C220S/S364K/E357Q

SEQ ID NO: 677 - protein, 623 aa, Artificial Sequence
  Description of Artificial Sequence: Synthetic polypeptide
  XENC1005 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 678 - protein, 220 aa, Artificial Sequence; identical to SEQ ID NO: 136
  Description of Artificial Sequence: Synthetic polypeptide
  XENC1005 Chain 3 - [alphaFAP]_L0

SEQ ID NO: 679 - protein, 453 aa, Artificial Sequence; identical to SEQ ID NO: 621
  Description of Artificial Sequence: Synthetic polypeptide
  XENC1006 Chain 1 - [alphaFAP]_H0.26_IgG1_C220S/S364K/E357Q

SEQ ID NO: 680 - protein, 623 aa, Artificial Sequence
  Description of Artificial Sequence: Synthetic polypeptide
  XENC1006 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 681 - protein, 220 aa, Artificial Sequence; identical to SEQ ID NO: 136
  Description of Artificial Sequence: Synthetic polypeptide
  XENC1006 Chain 3 - [alphaFAP]_L0

SEQ ID NO: 682 - protein, 453 aa, Artificial Sequence; identical to SEQ ID NO: 621
  Description of Artificial Sequence: Synthetic polypeptide
  XENC1007 Chain 1 - [alphaFAP]_H0.26_IgG1_C220S/S364K/E357Q

SEQ ID NO: 683 - protein, 623 aa, Artificial Sequence
  Description of Artificial Sequence: Synthetic polypeptide
  XENC1007 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 684 - protein, 220 aa, Artificial Sequence; identical to SEQ ID NO: 136
  Description of Artificial Sequence: Synthetic polypeptide
  XENC1007 Chain 3 - [alphaFAP]_L0

SEQ ID NO: 685 - protein, 453 aa, Artificial Sequence; identical to SEQ ID NO: 621
  Description of Artificial Sequence: Synthetic polypeptide
  XENC1008 Chain 1 - [alphaFAP]_H0.26_IgG1_C220S/S364K/E357Q

SEQ ID NO: 686 - protein, 623 aa, Artificial Sequence
  Description of Artificial Sequence: Synthetic polypeptide
  XENC1008 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 687 - protein, 220 aa, Artificial Sequence; identical to SEQ ID NO: 136
  Description of Artificial Sequence: Synthetic polypeptide
  XENC1008 Chain 3 - [alphaFAP]_L0

SEQ ID NO: 688 - protein, 453 aa, Artificial Sequence; identical to SEQ ID NO: 621
  Description of Artificial Sequence: Synthetic polypeptide
  XENC1009 Chain 1 - [alphaFAP]_H0.26_IgG1_C220S/S364K/E357Q

SEQ ID NO: 689 - protein, 623 aa, Artificial Sequence
  Description of Artificial Sequence: Synthetic polypeptide
  XENC1009 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 690 - protein, 220 aa, Artificial Sequence; identical to SEQ ID NO: 136
  Description of Artificial Sequence: Synthetic polypeptide
  XENC1009 Chain 3 - [alphaFAP]_L0

SEQ ID NO: 691 - protein, 453 aa, Artificial Sequence; identical to SEQ ID NO: 621
  Description of Artificial Sequence: Synthetic polypeptide
  XENC1010 Chain 1 - [alphaFAP]_H0.26_IgG1_C220S/S364K/E357Q

SEQ ID NO: 692 - protein, 623 aa, Artificial Sequence
  Description of Artificial Sequence: Synthetic polypeptide
  XENC1010 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 693 - protein, 220 aa, Artificial Sequence; identical to SEQ ID NO: 136
  Description of Artificial Sequence: Synthetic polypeptide
  XENC1010 Chain 3 - [alphaFAP]_L0

SEQ ID NO: 694 - protein, 453 aa, Artificial Sequence; identical to SEQ ID NO: 621
  Description of Artificial Sequence: Synthetic polypeptide
  XENC1011 Chain 1 - [alphaFAP]_H0.26_IgG1_C220S/S364K/E357Q

SEQ ID NO: 695 - protein, 623 aa, Artificial Sequence
  Description of Artificial Sequence: Synthetic polypeptide
  XENC1011 Chain 2 - [alphaFAP]_H0.26_(G4S)2_[alphaCD3] _L1.47 _H1.89_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 696 - protein, 220 aa, Artificial Sequence; identical to SEQ ID NO: 136
  Description of Artificial Sequence: Synthetic polypeptide
  XENC1011 Chain 3 - [alphaFAP]_L0

SEQ ID NO: 697 - protein, 453 aa, Artificial Sequence; identical to SEQ ID NO: 621
  Description of Artificial Sequence: Synthetic polypeptide
  XENC1012 Chain 1 - [alphaFAP]_H0.26_IgG1_C220S/S364K/E357Q

SEQ ID NO: 698 - protein, 623 aa, Artificial Sequence
  Description of Artificial Sequence: Synthetic polypeptide
  XENC1012 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 699 - protein, 220 aa, Artificial Sequence; identical to SEQ ID NO: 136
  Description of Artificial Sequence: Synthetic polypeptide
  XENC1012 Chain 3 - [alphaFAP]_L0

SEQ ID NO: 700 - protein, 453 aa, Artificial Sequence; identical to SEQ ID NO: 621
  Description of Artificial Sequence: Synthetic polypeptide
  XENC1013 Chain 1 - [alphaFAP]_H0.26_IgG1_C220S/S364K/E357Q

SEQ ID NO: 701 - protein, 623 aa, Artificial Sequence
  Description of Artificial Sequence: Synthetic polypeptide
  XENC1013 Chain 2 - [alphaFAP]_H0.26_(G4S)2_[alphaCD3] _L1.47 _H1.33_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 702 - protein, 220 aa, Artificial Sequence; identical to SEQ ID NO: 136
  Description of Artificial Sequence: Synthetic polypeptide
  XENC1013 Chain 3 - [alphaFAP]_L0

SEQ ID NO: 703 - protein, 453 aa, Artificial Sequence; identical to SEQ ID NO: 621
  Description of Artificial Sequence: Synthetic polypeptide
  XENC1014 Chain 1 - [alphaFAP]_H0.26_IgG1_C220S/S364K/E357Q

SEQ ID NO: 704 - protein, 623 aa, Artificial Sequence
  Description of Artificial Sequence: Synthetic polypeptide
  XENC1014 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric_A _L368D/K370S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 705 - protein, 220 aa, Artificial Sequence; identical to SEQ ID NO: 136
  Description of Artificial Sequence: Synthetic polypeptide
  XENC1014 Chain 3 - [alphaFAP]_L0

SEQ ID NO: 706 - protein, 453 aa, Artificial Sequence; identical to SEQ ID NO: 649
  Description of Artificial Sequence: Synthetic polypeptide
  XENC1015 Chain 1 - [alphaFAP]_H0.26_IgG1 _C220S/S364K/E357Q/M428L/N434S

SEQ ID NO: 707 - protein, 623 aa, Artificial Sequence
  Description of Artificial Sequence: Synthetic polypeptide
  XENC1015 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 708 - protein, 220 aa, Artificial Sequence; identical to SEQ ID NO: 136
  Description of Artificial Sequence: Synthetic polypeptide
  XENC1015 Chain 3 - [alphaFAP]_L0

SEQ ID NO: 709 - protein, 453 aa, Artificial Sequence; identical to SEQ ID NO: 649
  Description of Artificial Sequence: Synthetic polypeptide
  XENP29140 Chain 1 - [alphaFAP]_H0.26_IgG1 _C220S/S364K/E357Q/M428L/N434S

SEQ ID NO: 710 - protein, 623 aa, Artificial Sequence
  Description of Artificial Sequence: Synthetic polypeptide
  XENP29140 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 711 - protein, 220 aa, Artificial Sequence; identical to SEQ ID NO: 136
  Description of Artificial Sequence: Synthetic polypeptide
  XENP29140 Chain 3 - [alphaFAP]_L0

SEQ ID NO: 712 - protein, 453 aa, Artificial Sequence; identical to SEQ ID NO: 649
  Description of Artificial Sequence: Synthetic polypeptide
  XENC1016 Chain 1 - [alphaFAP]_H0.26_IgG1 _C220S/S364K/E357Q/M428L/N434S

SEQ ID NO: 713 - protein, 623 aa, Artificial Sequence
  Description of Artificial Sequence: Synthetic polypeptide
  XENC1016 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 714 - protein, 220 aa, Artificial Sequence; identical to SEQ ID NO: 136
  Description of Artificial Sequence: Synthetic polypeptide
  XENC1016 Chain 3 - [alphaFAP]_L0

SEQ ID NO: 715 - protein, 453 aa, Artificial Sequence; identical to SEQ ID NO: 649
  Description of Artificial Sequence: Synthetic polypeptide
  XENC1017 Chain 1 - [alphaFAP]_H0.26_IgG1 _C220S/S364K/E357Q/M428L/N434S

SEQ ID NO: 716 - protein, 623 aa, Artificial Sequence
  Description of Artificial Sequence: Synthetic polypeptide
  XENC1017 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 717 - protein, 220 aa, Artificial Sequence; identical to SEQ ID NO: 136
  Description of Artificial Sequence: Synthetic polypeptide
  XENC1017 Chain 3 - [alphaFAP]_L0

SEQ ID NO: 718 - protein, 453 aa, Artificial Sequence; identical to SEQ ID NO: 649
  Description of Artificial Sequence: Synthetic polypeptide
  XENC1018 Chain 1 - [alphaFAP]_H0.26_IgG1 _C220S/S364K/E357Q/M428L/N434S

SEQ ID NO: 719 - protein, 623 aa, Artificial Sequence
  Description of Artificial Sequence: Synthetic polypeptide
  XENC1018 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 720 - protein, 220 aa, Artificial Sequence; identical to SEQ ID NO: 136
  Description of Artificial Sequence: Synthetic polypeptide
  XENC1018 Chain 3 - [alphaFAP]_L0

SEQ ID NO: 721 - protein, 453 aa, Artificial Sequence; identical to SEQ ID NO: 649
  Description of Artificial Sequence: Synthetic polypeptide
  XENC1019 Chain 1 - [alphaFAP]_H0.26_IgG1 _C220S/S364K/E357Q/M428L/N434S

SEQ ID NO: 722 - protein, 623 aa, Artificial Sequence
  Description of Artificial Sequence: Synthetic polypeptide
  XENC1019 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 723 - protein, 220 aa, Artificial Sequence; identical to SEQ ID NO: 136
  Description of Artificial Sequence: Synthetic polypeptide
  XENC1019 Chain 3 - [alphaFAP]_L0

SEQ ID NO: 724 - protein, 453 aa, Artificial Sequence; identical to SEQ ID NO: 649
  Description of Artificial Sequence: Synthetic polypeptide
  XENC1020 Chain 1 - [alphaFAP]_H0.26_IgG1 _C220S/S364K/E357Q/M428L/N434S

SEQ ID NO: 725 - protein, 623 aa, Artificial Sequence
  Description of Artificial Sequence: Synthetic polypeptide
  XENC1020 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 726 - protein, 220 aa, Artificial Sequence; identical to SEQ ID NO: 136
  Description of Artificial Sequence: Synthetic polypeptide
  XENC1020 Chain 3 - [alphaFAP]_L0

SEQ ID NO: 727 - protein, 453 aa, Artificial Sequence; identical to SEQ ID NO: 649
  Description of Artificial Sequence: Synthetic polypeptide
  XENC1021 Chain 1 - [alphaFAP]_H0.26_IgG1 _C220S/S364K/E357Q/M428L/N434S

SEQ ID NO: 728 - protein, 623 aa, Artificial Sequence
  Description of Artificial Sequence: Synthetic polypeptide
  XENC1021 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 729 - protein, 220 aa, Artificial Sequence; identical to SEQ ID NO: 136
  Description of Artificial Sequence: Synthetic polypeptide
  XENC1021 Chain 3 - [alphaFAP]_L0

SEQ ID NO: 730 - protein, 453 aa, Artificial Sequence; identical to SEQ ID NO: 649
  Description of Artificial Sequence: Synthetic polypeptide
  XENC1022 Chain 1 - [alphaFAP]_H0.26_IgG1 _C220S/S364K/E357Q/M428L/N434S

SEQ ID NO: 731 - protein, 623 aa, Artificial Sequence
  Description of Artificial Sequence: Synthetic polypeptide
  XENC1022 Chain 2 - [alphaFAP]_H0.26_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 732 - protein, 220 aa, Artificial Sequence; identical to SEQ ID NO: 136
  Description of Artificial Sequence: Synthetic polypeptide
  XENC1022 Chain 3 - [alphaFAP]_L0

SEQ ID NO: 733 - protein, 453 aa, Artificial Sequence; identical to SEQ ID NO: 649
  Description of Artificial Sequence: Synthetic polypeptide
  XENC1023 Chain 1 - [alphaFAP]_H0.26_IgG1 _C220S/S364K/E357Q/M428L/N434S

SEQ ID NO: 734 - protein, 623 aa, Artificial Sequence
  Description of Artificial Sequence: Synthetic polypeptide
  XENC1023 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 735 - protein, 220 aa, Artificial Sequence; identical to SEQ ID NO: 136
  Description of Artificial Sequence: Synthetic polypeptide
  XENC1023 Chain 3 - [alphaFAP]_L0

SEQ ID NO: 736 - protein, 453 aa, Artificial Sequence; identical to SEQ ID NO: 649
  Description of Artificial Sequence: Synthetic polypeptide
  XENC1024 Chain 1 - [alphaFAP]_H0.26_IgG1 _C220S/S364K/E357Q/M428L/N434S

SEQ ID NO: 737 - protein, 623 aa, Artificial Sequence
  Description of Artificial Sequence: Synthetic polypeptide
  XENC1024 Chain 2 - [alphaFAP]_H0.26_(G4S)2_[alphaCD3] _L1.47 _H1.33_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 738 - protein, 220 aa, Artificial Sequence; identical to SEQ ID NO: 136
  Description of Artificial Sequence: Synthetic polypeptide
  XENC1024 Chain 3 - [alphaFAP]_L0

SEQ ID NO: 739 - protein, 453 aa, Artificial Sequence; identical to SEQ ID NO: 649
  Description of Artificial Sequence: Synthetic polypeptide
  XENC1025 Chain 1 - [alphaFAP]_H0.26_IgG1 _C220S/S364K/E357Q/M428L/N434S

SEQ ID NO: 740 - protein, 623 aa, Artificial Sequence
  Description of Artificial Sequence: Synthetic polypeptide
  XENC1025 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S
QVQLVQSGAEVKKPGASVKVSCKTSRYTFTEYSIHWVRQAPGQRLEWIGGINPNTGIPNYNQKFKGRVTITVDTSASTAYMELSSLRSEDTAVYYCARRRIAYGYDEGHAMDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 741 - protein, 220 aa, Artificial Sequence; identical to SEQ ID NO: 136
  Description of Artificial Sequence: Synthetic polypeptide
  XENC1025 Chain 3 - [alphaFAP]_L0

SEQ ID NO: 742 - protein, 453 aa, Artificial Sequence; identical to SEQ ID NO: 621
  Description of Artificial Sequence: Synthetic polypeptide
  XENP28118 Chain 1 - [alphaFAP]_H0.26_IgG1_C220S/S364K/E357Q

SEQ ID NO: 743 - protein, 623 aa, Artificial Sequence; identical to SEQ ID NO: 671
  Description of Artificial Sequence: Synthetic polypeptide
  XENP28118 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S

SEQ ID NO: 744 - protein, 220 aa, Artificial Sequence; identical to SEQ ID NO: 529
  Description of Artificial Sequence: Synthetic polypeptide
  XENP28118 Chain 3 - [alphaFAP]_L0.11

SEQ ID NO: 745 - protein, 453 aa, Artificial Sequence; identical to SEQ ID NO: 621
  Description of Artificial Sequence: Synthetic polypeptide
  XENP28116 Chain 1 - [alphaFAP]_H0.26_IgG1_C220S/S364K/E357Q

SEQ ID NO: 746 - protein, 623 aa, Artificial Sequence; identical to SEQ ID NO: 674
  Description of Artificial Sequence: Synthetic polypeptide
  XENP28116 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S

SEQ ID NO: 747 - protein, 220 aa, Artificial Sequence; identical to SEQ ID NO: 529
  Description of Artificial Sequence: Synthetic polypeptide
  XENP28116 Chain 3 - [alphaFAP]_L0.11

SEQ ID NO: 748 - protein, 453 aa, Artificial Sequence; identical to SEQ ID NO: 621
  Description of Artificial Sequence: Synthetic polypeptide
  XENC1026 Chain 1 - [alphaFAP]_H0.26_IgG1_C220S/S364K/E357Q

SEQ ID NO: 749 - protein, 623 aa, Artificial Sequence; identical to SEQ ID NO: 677
  Description of Artificial Sequence: Synthetic polypeptide
  XENC1026 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S

SEQ ID NO: 750 - protein, 220 aa, Artificial Sequence; identical to SEQ ID NO: 529
  Description of Artificial Sequence: Synthetic polypeptide
  XENC1026 Chain 3 - [alphaFAP]_L0.11

SEQ ID NO: 751 - protein, 453 aa, Artificial Sequence; identical to SEQ ID NO: 621
  Description of Artificial Sequence: Synthetic polypeptide
  XENC1027 Chain 1 - [alphaFAP]_H0.26_IgG1_C220S/S364K/E357Q

SEQ ID NO: 752 - protein, 623 aa, Artificial Sequence; identical to SEQ ID NO: 680
  Description of Artificial Sequence: Synthetic polypeptide
  XENC1027 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S

SEQ ID NO: 753 - protein, 220 aa, Artificial Sequence; identical to SEQ ID NO: 529
  Description of Artificial Sequence: Synthetic polypeptide
  XENC1027 Chain 3 - [alphaFAP]_L0.11

SEQ ID NO: 754 - protein, 453 aa, Artificial Sequence; identical to SEQ ID NO: 621
  Description of Artificial Sequence: Synthetic polypeptide
  XENC1028 Chain 1 - [alphaFAP]_H0.26_IgG1_C220S/S364K/E357Q

SEQ ID NO: 755 - protein, 623 aa, Artificial Sequence; identical to SEQ ID NO: 683
  Description of Artificial Sequence: Synthetic polypeptide
  XENC1028 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S

SEQ ID NO: 756 - protein, 220 aa, Artificial Sequence; identical to SEQ ID NO: 529
  Description of Artificial Sequence: Synthetic polypeptide
  XENC1028 Chain 3 - [alphaFAP]_L0.11

SEQ ID NO: 757 - protein, 453 aa, Artificial Sequence; identical to SEQ ID NO: 621
  Description of Artificial Sequence: Synthetic polypeptide
  XENC1029 Chain 1 - [alphaFAP]_H0.26_IgG1_C220S/S364K/E357Q

SEQ ID NO: 758 - protein, 623 aa, Artificial Sequence; identical to SEQ ID NO: 686
  Description of Artificial Sequence: Synthetic polypeptide
  XENC1029 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S

SEQ ID NO: 759 - protein, 220 aa, Artificial Sequence; identical to SEQ ID NO: 529
  Description of Artificial Sequence: Synthetic polypeptide
  XENC1029 Chain 3 - [alphaFAP]_L0.11

SEQ ID NO: 760 - protein, 453 aa, Artificial Sequence; identical to SEQ ID NO: 621
  Description of Artificial Sequence: Synthetic polypeptide
  XENC1030 Chain 1 - [alphaFAP]_H0.26_IgG1_C220S/S364K/E357Q

SEQ ID NO: 761 - protein, 623 aa, Artificial Sequence; identical to SEQ ID NO: 689
  Description of Artificial Sequence: Synthetic polypeptide
  XENC1030 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S

SEQ ID NO: 762 - protein, 220 aa, Artificial Sequence; identical to SEQ ID NO: 529
  Description of Artificial Sequence: Synthetic polypeptide
  XENC1030 Chain 3 - [alphaFAP]_L0.11

SEQ ID NO: 763 - protein, 453 aa, Artificial Sequence; identical to SEQ ID NO: 621
  Description of Artificial Sequence: Synthetic polypeptide
  XENC1031 Chain 1 - [alphaFAP]_H0.26_IgG1_C220S/S364K/E357Q

SEQ ID NO: 764 - protein, 623 aa, Artificial Sequence; identical to SEQ ID NO: 692
  Description of Artificial Sequence: Synthetic polypeptide
  XENC1031 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S

SEQ ID NO: 765 - protein, 220 aa, Artificial Sequence; identical to SEQ ID NO: 529
  Description of Artificial Sequence: Synthetic polypeptide
  XENC1031 Chain 3 - [alphaFAP]_L0.11

SEQ ID NO: 766 - protein, 453 aa, Artificial Sequence; identical to SEQ ID NO: 621
  Description of Artificial Sequence: Synthetic polypeptide
  XENC1032 Chain 1 - [alphaFAP]_H0.26_IgG1_C220S/S364K/E357Q

SEQ ID NO: 767 - protein, 623 aa, Artificial Sequence; identical to SEQ ID NO: 695
  Description of Artificial Sequence: Synthetic polypeptide
  XENC1032 Chain 2 - [alphaFAP]_H0.26_(G4S)2_[alphaCD3] _L1.47_ H1.89_scFv(GKPGS)4_(G4S)2_IgG1_PVA_/S267K-pI(-)_Isosteric_A_ L368D/K370S

SEQ ID NO: 768 - protein, 220 aa, Artificial Sequence; identical to SEQ ID NO: 529
  Description of Artificial Sequence: Synthetic polypeptide
  XENC1032 Chain 3 - [alphaFAP]_L0.11

SEQ ID NO: 769 - protein, 453 aa, Artificial Sequence; identical to SEQ ID NO: 621
  Description of Artificial Sequence: Synthetic polypeptide
  XENC1033 Chain 1 - [alphaFAP]_H0.26_IgG1_C220S/S364K/E357Q

SEQ ID NO: 770 - protein, 623 aa, Artificial Sequence; identical to SEQ ID NO: 698
  Description of Artificial Sequence: Synthetic polypeptide
  XENC1033 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S

SEQ ID NO: 771 - protein, 220 aa, Artificial Sequence; identical to SEQ ID NO: 529
  Description of Artificial Sequence: Synthetic polypeptide
  XENC1033 Chain 3 - [alphaFAP]_L0.11

SEQ ID NO: 772 - protein, 453 aa, Artificial Sequence; identical to SEQ ID NO: 621
  Description of Artificial Sequence: Synthetic polypeptide
  XENC1034 Chain 1 - [alphaFAP]_H0.26_IgG1_C220S/S364K/E357Q

SEQ ID NO: 773 - protein, 623 aa, Artificial Sequence; identical to SEQ ID NO: 701
  Description of Artificial Sequence: Synthetic polypeptide
  XENC1034 Chain 2 - [alphaFAP]_H0.26_(G4S)2_[alphaCD3] _L1.47 _H1.33_scFv(GKPGS)4_(G4S)2_IgG1_PVA_/S267K-pI(-)_Isosteric _A_L368D/K370S

SEQ ID NO: 774 - protein, 220 aa, Artificial Sequence; identical to SEQ ID NO: 529
  Description of Artificial Sequence: Synthetic polypeptide
  XENC1034 Chain 3 - [alphaFAP]_L0.11

SEQ ID NO: 775 - protein, 453 aa, Artificial Sequence; identical to SEQ ID NO: 621
  Description of Artificial Sequence: Synthetic polypeptide
  XENC1035 Chain 1 - [alphaFAP]_H0.26_IgG1_C220S/S364K/E357Q

SEQ ID NO: 776 - protein, 623 aa, Artificial Sequence; identical to SEQ ID NO: 704
  Description of Artificial Sequence: Synthetic polypeptide
  XENC1035 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric _A_L368D/K370S

SEQ ID NO: 777 - protein, 220 aa, Artificial Sequence; identical to SEQ ID NO: 529
  Description of Artificial Sequence: Synthetic polypeptide
  XENC1035 Chain 3 - [alphaFAP]_L0.11

SEQ ID NO: 778 - protein, 453 aa, Artificial Sequence; identical to SEQ ID NO: 649
  Description of Artificial Sequence: Synthetic polypeptide
  XENC1036 Chain 1 - [alphaFAP]_H0.26_IgG1 _C220S/S364K/E357Q/M428L/N434S

SEQ ID NO: 779 - protein, 623 aa, Artificial Sequence; identical to SEQ ID NO: 707
  Description of Artificial Sequence: Synthetic polypeptide
  XENC1036 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S

SEQ ID NO: 780 - protein, 220 aa, Artificial Sequence; identical to SEQ ID NO: 529
  Description of Artificial Sequence: Synthetic polypeptide
  XENC1036 Chain 3 - [alphaFAP]_L0.11

SEQ ID NO: 781 - protein, 453 aa, Artificial Sequence; identical to SEQ ID NO: 649
  Description of Artificial Sequence: Synthetic polypeptide
  XENP29142 Chain 1 - [alphaFAP]_H0.26_IgG1 _C220S/S364K/E357Q/M428L/N434S

SEQ ID NO: 782 - protein, 623 aa, Artificial Sequence; identical to SEQ ID NO: 710
  Description of Artificial Sequence: Synthetic polypeptide
  XENP29142 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S

SEQ ID NO: 783 - protein, 220 aa, Artificial Sequence; identical to SEQ ID NO: 529
  Description of Artificial Sequence: Synthetic polypeptide
  XENP29142 Chain 3 - [alphaFAP]_L0.11

SEQ ID NO: 784 - protein, 453 aa, Artificial Sequence; identical to SEQ ID NO: 649
  Description of Artificial Sequence: Synthetic polypeptide
  XENC1037 Chain 1 - [alphaFAP]_H0.26_IgG1 _C220S/S364K/E357Q/M428L/N434S

SEQ ID NO: 785 - protein, 623 aa, Artificial Sequence; identical to SEQ ID NO: 713
  Description of Artificial Sequence: Synthetic polypeptide
  XENC1037 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S

SEQ ID NO: 786 - protein, 220 aa, Artificial Sequence; identical to SEQ ID NO: 529
  Description of Artificial Sequence: Synthetic polypeptide
  XENC1037 Chain 3 - [alphaFAP]_L0.11

SEQ ID NO: 787 - protein, 453 aa, Artificial Sequence; identical to SEQ ID NO: 649
  Description of Artificial Sequence: Synthetic polypeptide
  XENC1038 Chain 1 - [alphaFAP]_H0.26_IgG1 _C220S/S364K/E357Q/M428L/N434S

SEQ ID NO: 788 - protein, 623 aa, Artificial Sequence; identical to SEQ ID NO: 716
  Description of Artificial Sequence: Synthetic polypeptide
  XENC1038 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S

SEQ ID NO: 789 - protein, 220 aa, Artificial Sequence; identical to SEQ ID NO: 529
  Description of Artificial Sequence: Synthetic polypeptide
  XENC1038 Chain 3 - [alphaFAP]_L0.11

SEQ ID NO: 790 - protein, 453 aa, Artificial Sequence; identical to SEQ ID NO: 649
  Description of Artificial Sequence: Synthetic polypeptide
  XENC1039 Chain 1 - [alphaFAP]_H0.26_IgG1 _C220S/S364K/E357Q/M428L/N434S

SEQ ID NO: 791 - protein, 623 aa, Artificial Sequence; identical to SEQ ID NO: 719
  Description of Artificial Sequence: Synthetic polypeptide
  XENC1039 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S

SEQ ID NO: 792 - protein, 220 aa, Artificial Sequence; identical to SEQ ID NO: 529
  Description of Artificial Sequence: Synthetic polypeptide
  XENC1039 Chain 3 - [alphaFAP]_L0.11

SEQ ID NO: 793 - protein, 453 aa, Artificial Sequence; identical to SEQ ID NO: 649
  Description of Artificial Sequence: Synthetic polypeptide
  XENC1040 Chain 1 - [alphaFAP]_H0.26_IgG1 _C220S/S364K/E357Q/M428L/N434S

SEQ ID NO: 794 - protein, 623 aa, Artificial Sequence; identical to SEQ ID NO: 722
  Description of Artificial Sequence: Synthetic polypeptide
  XENC1040 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S

SEQ ID NO: 795 - protein, 220 aa, Artificial Sequence; identical to SEQ ID NO: 529
  Description of Artificial Sequence: Synthetic polypeptide
  XENC1040 Chain 3 - [alphaFAP]_L0.11

SEQ ID NO: 796 - protein, 453 aa, Artificial Sequence; identical to SEQ ID NO: 649
  Description of Artificial Sequence: Synthetic polypeptide
  XENC1041 Chain 1 - [alphaFAP]_H0.26_IgG1 _C220S/S364K/E357Q/M428L/N434S

SEQ ID NO: 797 - protein, 623 aa, Artificial Sequence; identical to SEQ ID NO: 725
  Description of Artificial Sequence: Synthetic polypeptide
  XENC1041 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S

SEQ ID NO: 798 - protein, 220 aa, Artificial Sequence; identical to SEQ ID NO: 529
  Description of Artificial Sequence: Synthetic polypeptide
  XENC1041 Chain 3 - [alphaFAP]_L0.11

SEQ ID NO: 799 - protein, 453 aa, Artificial Sequence; identical to SEQ ID NO: 649
  Description of Artificial Sequence: Synthetic polypeptide
  XENC1042 Chain 1 - [alphaFAP]_H0.26_IgG1 _C220S/S364K/E357Q/M428L/N434S

SEQ ID NO: 800 - protein, 623 aa, Artificial Sequence; identical to SEQ ID NO: 728
  Description of Artificial Sequence: Synthetic polypeptide
  XENC1042 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S

SEQ ID NO: 801 - protein, 220 aa, Artificial Sequence; identical to SEQ ID NO: 529
  Description of Artificial Sequence: Synthetic polypeptide
  XENC1042 Chain 3 - [alphaFAP]_L0.11

SEQ ID NO: 802 - protein, 453 aa, Artificial Sequence; identical to SEQ ID NO: 649
  Description of Artificial Sequence: Synthetic polypeptide
  XENC1043 Chain 1 - [alphaFAP]_H0.26_IgG1 _C220S/S364K/E357Q/M428L/N434S

SEQ ID NO: 803 - protein, 623 aa, Artificial Sequence; identical to SEQ ID NO: 731
  Description of Artificial Sequence: Synthetic polypeptide
  XENC1043 Chain 2 - [alphaFAP]_H0.26_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S

SEQ ID NO: 804 - protein, 220 aa, Artificial Sequence; identical to SEQ ID NO: 529
  Description of Artificial Sequence: Synthetic polypeptide
  XENC1043 Chain 3 - [alphaFAP]_L0.11

SEQ ID NO: 805 - protein, 453 aa, Artificial Sequence; identical to SEQ ID NO: 649
  Description of Artificial Sequence: Synthetic polypeptide
  XENC1044 Chain 1 - [alphaFAP]_H0.26_IgG1 _C220S/S364K/E357Q/M428L/N434S

SEQ ID NO: 806 - protein, 623 aa, Artificial Sequence; identical to SEQ ID NO: 734
  Description of Artificial Sequence: Synthetic polypeptide
  XENC1044 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S

SEQ ID NO: 807 - protein, 220 aa, Artificial Sequence; identical to SEQ ID NO: 529
  Description of Artificial Sequence: Synthetic polypeptide
  XENC1044 Chain 3 - [alphaFAP]_L0.11

SEQ ID NO: 808 - protein, 453 aa, Artificial Sequence; identical to SEQ ID NO: 649
  Description of Artificial Sequence: Synthetic polypeptide
  XENC1045 Chain 1 - [alphaFAP]_H0.26_IgG1_C220S/S364K/ E357Q/M428L/N434S

SEQ ID NO: 809 - protein, 623 aa, Artificial Sequence; identical to SEQ ID NO: 737
  Description of Artificial Sequence: Synthetic polypeptide
  XENC1045 Chain 2 - [alphaFAP]_H0.26_(G4S)2_[alphaCD3] _L1.47_H1.33_scFv(GKPGS)4_(G4S)2_IgG1_PVA_/S267K-pI(-) _Isosteric_A_L368D/K370S/M428L/N434S

SEQ ID NO: 810 - protein, 220 aa, Artificial Sequence; identical to SEQ ID NO: 529
  Description of Artificial Sequence: Synthetic polypeptide
  XENC1045 Chain 3 - [alphaFAP]_L0.11

SEQ ID NO: 811 - protein, 453 aa, Artificial Sequence; identical to SEQ ID NO: 649
  Description of Artificial Sequence: Synthetic polypeptide
  XENC1046 Chain 1 - [alphaFAP]_H0.26_IgG1 _C220S/S364K/E357Q/M428L/N434S

SEQ ID NO: 812 - protein, 623 aa, Artificial Sequence; identical to SEQ ID NO: 740
  Description of Artificial Sequence: Synthetic polypeptide
  XENC1046 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S

SEQ ID NO: 813 - protein, 220 aa, Artificial Sequence; identical to SEQ ID NO: 529
  Description of Artificial Sequence: Synthetic polypeptide
  XENC1046 Chain 3 - [alphaFAP]_L0.11

SEQ ID NO: 814 - protein, 453 aa, Artificial Sequence; identical to SEQ ID NO: 621
  Description of Artificial Sequence: Synthetic polypeptide
  XENP28117 Chain 1 - [alphaFAP]_H0.26_IgG1_C220S/S364K/E357Q

SEQ ID NO: 815 - protein, 623 aa, Artificial Sequence; identical to SEQ ID NO: 671
  Description of Artificial Sequence: Synthetic polypeptide
  XENP28117 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S

SEQ ID NO: 816 - protein, 220 aa, Artificial Sequence; identical to SEQ ID NO: 545
  Description of Artificial Sequence: Synthetic polypeptide
  XENP28117 Chain 3 - [alphaFAP]_L0.19

SEQ ID NO: 817 - protein, 453 aa, Artificial Sequence; identical to SEQ ID NO: 621
  Description of Artificial Sequence: Synthetic polypeptide
  XENP28115 Chain 1 - [alphaFAP]_H0.26_IgG1_C220S/S364K/E357Q

SEQ ID NO: 818 - protein, 623 aa, Artificial Sequence; identical to SEQ ID NO: 674
  Description of Artificial Sequence: Synthetic polypeptide
  XENP28115 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S

SEQ ID NO: 819 - protein, 220 aa, Artificial Sequence; identical to SEQ ID NO: 545
  Description of Artificial Sequence: Synthetic polypeptide
  XENP28115 Chain 3 - [alphaFAP]_L0.19

SEQ ID NO: 820 - protein, 453 aa, Artificial Sequence; identical to SEQ ID NO: 621
  Description of Artificial Sequence: Synthetic polypeptide
  XENC1047 Chain 1 - [alphaFAP]_H0.26_IgG1_C220S/S364K/E357Q

SEQ ID NO: 821 - protein, 623 aa, Artificial Sequence; identical to SEQ ID NO: 677
  Description of Artificial Sequence: Synthetic polypeptide
  XENC1047 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S

SEQ ID NO: 822 - protein, 220 aa, Artificial Sequence; identical to SEQ ID NO: 545
  Description of Artificial Sequence: Synthetic polypeptide
  XENC1047 Chain 3 - [alphaFAP]_L0.19

SEQ ID NO: 823 - protein, 453 aa, Artificial Sequence; identical to SEQ ID NO: 621
  Description of Artificial Sequence: Synthetic polypeptide
  XENC1048 Chain 1 - [alphaFAP]_H0.26_IgG1_C220S/S364K/E357Q

SEQ ID NO: 824 - protein, 623 aa, Artificial Sequence; identical to SEQ ID NO: 680
  Description of Artificial Sequence: Synthetic polypeptide
  XENC1048 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S

SEQ ID NO: 825 - protein, 220 aa, Artificial Sequence; identical to SEQ ID NO: 545
  Description of Artificial Sequence: Synthetic polypeptide
  XENC1048 Chain 3 - [alphaFAP]_L0.19

SEQ ID NO: 826 - protein, 453 aa, Artificial Sequence; identical to SEQ ID NO: 621
  Description of Artificial Sequence: Synthetic polypeptide
  XENC1049 Chain 1 - [alphaFAP]_H0.26_IgG1_C220S/S364K/E357Q

SEQ ID NO: 827 - protein, 623 aa, Artificial Sequence; identical to SEQ ID NO: 683
  Description of Artificial Sequence: Synthetic polypeptide
  XENC1049 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S

SEQ ID NO: 828 - protein, 220 aa, Artificial Sequence; identical to SEQ ID NO: 545
  Description of Artificial Sequence: Synthetic polypeptide
  XENC1049 Chain 3 - [alphaFAP]_L0.19

SEQ ID NO: 829 - protein, 453 aa, Artificial Sequence; identical to SEQ ID NO: 621
  Description of Artificial Sequence: Synthetic polypeptide
  XENC1050 Chain 1 - [alphaFAP]_H0.26_IgG1_C220S/S364K/E357Q

SEQ ID NO: 830 - protein, 623 aa, Artificial Sequence; identical to SEQ ID NO: 686
  Description of Artificial Sequence: Synthetic polypeptide
  XENC1050 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S

SEQ ID NO: 831 - protein, 220 aa, Artificial Sequence; identical to SEQ ID NO: 545
  Description of Artificial Sequence: Synthetic polypeptide
  XENC1050 Chain 3 - [alphaFAP]_L0.19

SEQ ID NO: 832 - protein, 453 aa, Artificial Sequence; identical to SEQ ID NO: 621
  Description of Artificial Sequence: Synthetic polypeptide
  XENC1051 Chain 1 - [alphaFAP]_H0.26_IgG1_C220S/S364K/E357Q

SEQ ID NO: 833 - protein, 623 aa, Artificial Sequence; identical to SEQ ID NO: 689
  Description of Artificial Sequence: Synthetic polypeptide
  XENC1051 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S

SEQ ID NO: 834 - protein, 220 aa, Artificial Sequence; identical to SEQ ID NO: 545
  Description of Artificial Sequence: Synthetic polypeptide
  XENC1051 Chain 3 - [alphaFAP]_L0.19

SEQ ID NO: 835 - protein, 453 aa, Artificial Sequence; identical to SEQ ID NO: 621
  Description of Artificial Sequence: Synthetic polypeptide
  XENC1052 Chain 1 - [alphaFAP]_H0.26_IgG1_C220S/S364K/E357Q

SEQ ID NO: 836 - protein, 623 aa, Artificial Sequence; identical to SEQ ID NO: 692
  Description of Artificial Sequence: Synthetic polypeptide
  XENC1052 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S

SEQ ID NO: 837 - protein, 220 aa, Artificial Sequence; identical to SEQ ID NO: 545
  Description of Artificial Sequence: Synthetic polypeptide
  XENC1052 Chain 3 - [alphaFAP]_L0.19

SEQ ID NO: 838 - protein, 453 aa, Artificial Sequence; identical to SEQ ID NO: 621
  Description of Artificial Sequence: Synthetic polypeptide
  XENC1053 Chain 1 - [alphaFAP]_H0.26_IgG1_C220S/S364K/E357Q

SEQ ID NO: 839 - protein, 623 aa, Artificial Sequence; identical to SEQ ID NO: 695
  Description of Artificial Sequence: Synthetic polypeptide
  XENC1053 Chain 2 - [alphaFAP]_H0.26_(G4S)2_[alphaCD3] _L1.47 _H1.89_scFv(GKPGS)4_(G4S)2_IgG1_PVA_/S267K-pI(-)_Isosteric_A _L368D/K370S

SEQ ID NO: 840 - protein, 220 aa, Artificial Sequence; identical to SEQ ID NO: 545
  Description of Artificial Sequence: Synthetic polypeptide
  XENC1053 Chain 3 - [alphaFAP]_L0.19

SEQ ID NO: 841 - protein, 453 aa, Artificial Sequence; identical to SEQ ID NO: 621
  Description of Artificial Sequence: Synthetic polypeptide
  XENC1054 Chain 1 - [alphaFAP]_H0.26_IgG1_C220S/S364K/E357Q

SEQ ID NO: 842 - protein, 623 aa, Artificial Sequence; identical to SEQ ID NO: 698
  Description of Artificial Sequence: Synthetic polypeptide
  XENC1054 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S

SEQ ID NO: 843 - protein, 220 aa, Artificial Sequence; identical to SEQ ID NO: 545
  Description of Artificial Sequence: Synthetic polypeptide
  XENC1054 Chain 3 - [alphaFAP]_L0.19

SEQ ID NO: 844 - protein, 453 aa, Artificial Sequence; identical to SEQ ID NO: 621
  Description of Artificial Sequence: Synthetic polypeptide
  XENC1055 Chain 1 - [alphaFAP]_H0.26_IgG1_C220S/S364K/E357Q

SEQ ID NO: 845 - protein, 623 aa, Artificial Sequence; identical to SEQ ID NO: 701
  Description of Artificial Sequence: Synthetic polypeptide
  XENC1055 Chain 2 - [alphaFAP]_H0.26_(G4S)2_[alphaCD3] _L1.47 _H1.33_scFv(GKPGS)4_(G4S)2_IgG1_PVA_/S267K-pI(-)_Isosteric_A _L368D/K370S

SEQ ID NO: 846 - protein, 220 aa, Artificial Sequence; identical to SEQ ID NO: 545
  Description of Artificial Sequence: Synthetic polypeptide
  XENC1055 Chain 3 - [alphaFAP]_L0.19

SEQ ID NO: 847 - protein, 453 aa, Artificial Sequence; identical to SEQ ID NO: 621
  Description of Artificial Sequence: Synthetic polypeptide
  XENC1056 Chain 1 - [alphaFAP]_H0.26_IgG1_C220S/S364K/E357Q

SEQ ID NO: 848 - protein, 623 aa, Artificial Sequence; identical to SEQ ID NO: 704
  Description of Artificial Sequence: Synthetic polypeptide
  XENC1056 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric_A _L368D/K370S

SEQ ID NO: 849 - protein, 220 aa, Artificial Sequence; identical to SEQ ID NO: 545
  Description of Artificial Sequence: Synthetic polypeptide
  XENC1056 Chain 3 - [alphaFAP]_L0.19

SEQ ID NO: 850 - protein, 453 aa, Artificial Sequence; identical to SEQ ID NO: 649
  Description of Artificial Sequence: Synthetic polypeptide
  XENC1057 Chain 1 - [alphaFAP]_H0.26_IgG1 _C220S/S364K/E357Q/M428L/N434S

SEQ ID NO: 851 - protein, 623 aa, Artificial Sequence; identical to SEQ ID NO: 707
  Description of Artificial Sequence: Synthetic polypeptide
  XENC1057 Chain 2 - [alphaFAP]_H0.26_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S

SEQ ID NO: 852 - protein, 220 aa, Artificial Sequence; identical to SEQ ID NO: 545
  Description of Artificial Sequence: Synthetic polypeptide
  XENC1057 Chain 3 - [alphaFAP]_L0.19

SEQ ID NO: 853 - protein, 453 aa, Artificial Sequence; identical to SEQ ID NO: 649
  Description of Artificial Sequence: Synthetic polypeptide
  XENP29141 Chain 1 - [alphaFAP]_H0.26_IgG1 _C220S/S364K/E357Q/M428L/N434S

SEQ ID NO: 854 - protein, 623 aa, Artificial Sequence; identical to SEQ ID NO: 710
  Description of Artificial Sequence: Synthetic polypeptide
  XENP29141 Chain 2 - [alphaFAP]_H0.26_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S

SEQ ID NO: 855 - protein, 220 aa, Artificial Sequence; identical to SEQ ID NO: 545
  Description of Artificial Sequence: Synthetic polypeptide
  XENP29141 Chain 3 - [alphaFAP]_L0.19

SEQ ID NO: 856 - protein, 453 aa, Artificial Sequence; identical to SEQ ID NO: 649
  Description of Artificial Sequence: Synthetic polypeptide
  XENC1058 Chain 1 - [alphaFAP]_H0.26_IgG1 _C220S/S364K/E357Q/M428L/N434S

SEQ ID NO: 857 - protein, 623 aa, Artificial Sequence; identical to SEQ ID NO: 713
  Description of Artificial Sequence: Synthetic polypeptide
  XENC1058 Chain 2 - [alphaFAP]_H0.26_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S

SEQ ID NO: 858 - protein, 220 aa, Artificial Sequence; identical to SEQ ID NO: 545
  Description of Artificial Sequence: Synthetic polypeptide
  XENC1058 Chain 3 - [alphaFAP]_L0.19

SEQ ID NO: 859 - protein, 453 aa, Artificial Sequence; identical to SEQ ID NO: 649
  Description of Artificial Sequence: Synthetic polypeptide
  XENC1059 Chain 1 - [alphaFAP]_H0.26_IgG1 _C220S/S364K/E357Q/M428L/N434S

SEQ ID NO: 860 - protein, 623 aa, Artificial Sequence; identical to SEQ ID NO: 716
  Description of Artificial Sequence: Synthetic polypeptide
  XENC1059 Chain 2 - [alphaFAP]_H0.26_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S

SEQ ID NO: 861 - protein, 220 aa, Artificial Sequence; identical to SEQ ID NO: 545
  Description of Artificial Sequence: Synthetic polypeptide
  XENC1059 Chain 3 - [alphaFAP]_L0.19

SEQ ID NO: 862 - protein, 453 aa, Artificial Sequence; identical to SEQ ID NO: 649
  Description of Artificial Sequence: Synthetic polypeptide
  XENC1060 Chain 1 - [alphaFAP]_H0.26_IgG1 _C220S/S364K/E357Q/M428L/N434S

SEQ ID NO: 863 - protein, 623 aa, Artificial Sequence; identical to SEQ ID NO: 719
  Description of Artificial Sequence: Synthetic polypeptide
  XENC1060 Chain 2 - [alphaFAP]_H0.26_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S

SEQ ID NO: 864 - protein, 220 aa, Artificial Sequence; identical to SEQ ID NO: 545
  Description of Artificial Sequence: Synthetic polypeptide
  XENC1060 Chain 3 - [alphaFAP]_L0.19

SEQ ID NO: 865 - protein, 453 aa, Artificial Sequence; identical to SEQ ID NO: 649
  Description of Artificial Sequence: Synthetic polypeptide
  XENC1061 Chain 1 - [alphaFAP]_H0.26_IgG1 _C220S/S364K/E357Q/M428L/N434S

SEQ ID NO: 866 - protein, 623 aa, Artificial Sequence; identical to SEQ ID NO: 722
  Description of Artificial Sequence: Synthetic polypeptide
  XENC1061 Chain 2 - [alphaFAP]_H0.26_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S

SEQ ID NO: 867 - protein, 220 aa, Artificial Sequence; identical to SEQ ID NO: 545
  Description of Artificial Sequence: Synthetic polypeptide
  XENC1061 Chain 3 - [alphaFAP]_L0.19

SEQ ID NO: 868 - protein, 453 aa, Artificial Sequence; identical to SEQ ID NO: 649
  Description of Artificial Sequence: Synthetic polypeptide
  XENC1062 Chain 1 - [alphaFAP]_H0.26_IgG1 _C220S/S364K/E357Q/M428L/N434S

SEQ ID NO: 869 - protein, 623 aa, Artificial Sequence; identical to SEQ ID NO: 725
  Description of Artificial Sequence: Synthetic polypeptide
  XENC1062 Chain 2 - [alphaFAP]_H0.26_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S

SEQ ID NO: 870 - protein, 220 aa, Artificial Sequence; identical to SEQ ID NO: 545
  Description of Artificial Sequence: Synthetic polypeptide
  XENC1062 Chain 3 - [alphaFAP]_L0.19

SEQ ID NO: 871 - protein, 453 aa, Artificial Sequence; identical to SEQ ID NO: 649
  Description of Artificial Sequence: Synthetic polypeptide
  XENC1063 Chain 1 - [alphaFAP]_H0.26_IgG1 _C220S/S364K/E357Q/M428L/N434S

SEQ ID NO: 872 - protein, 623 aa, Artificial Sequence; identical to SEQ ID NO: 728
  Description of Artificial Sequence: Synthetic polypeptide
  XENC1063 Chain 2 - [alphaFAP]_H0.26_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S

SEQ ID NO: 873 - protein, 220 aa, Artificial Sequence; identical to SEQ ID NO: 545
  Description of Artificial Sequence: Synthetic polypeptide
  XENC1063 Chain 3 - [alphaFAP]_L0.19

SEQ ID NO: 874 - protein, 453 aa, Artificial Sequence; identical to SEQ ID NO: 649
  Description of Artificial Sequence: Synthetic polypeptide
  XENC1064 Chain 1 - [alphaFAP]_H0.26_IgG1 _C220S/S364K/E357Q/M428L/N434S

SEQ ID NO: 875 - protein, 623 aa, Artificial Sequence; identical to SEQ ID NO: 731
  Description of Artificial Sequence: Synthetic polypeptide
  XENC1064 Chain 2 - [alphaFAP]_H0.26_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S

SEQ ID NO: 876 - protein, 220 aa, Artificial Sequence; identical to SEQ ID NO: 545
  Description of Artificial Sequence: Synthetic polypeptide
  XENC1064 Chain 3 - [alphaFAP]_L0.19

SEQ ID NO: 877 - protein, 453 aa, Artificial Sequence; identical to SEQ ID NO: 649
  Description of Artificial Sequence: Synthetic polypeptide
  XENC1065 Chain 1 - [alphaFAP]_H0.26_IgG1 _C220S/S364K/E357Q/M428L/N434S

SEQ ID NO: 878 - protein, 623 aa, Artificial Sequence; identical to SEQ ID NO: 734
  Description of Artificial Sequence: Synthetic polypeptide
  XENC1065 Chain 2 - [alphaFAP]_H0.26_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S

SEQ ID NO: 879 - protein, 220 aa, Artificial Sequence; identical to SEQ ID NO: 545
  Description of Artificial Sequence: Synthetic polypeptide
  XENC1065 Chain 3 - [alphaFAP]_L0.19

SEQ ID NO: 880 - protein, 453 aa, Artificial Sequence; identical to SEQ ID NO: 649
  Description of Artificial Sequence: Synthetic polypeptide
  XENC1066 Chain 1 - [alphaFAP]_H0.26_IgG1 _C220S/S364K/E357Q/M428L/N434S

SEQ ID NO: 881 - protein, 623 aa, Artificial Sequence; identical to SEQ ID NO: 737
  Description of Artificial Sequence: Synthetic polypeptide
  XENC1066 Chain 2 - [alphaFAP]_H0.26_(G4S)2_[alphaCD3] _L1.47 _H1.33_scFv(GKPGS)4_(G4S)2_IgG1_PVA_/S267K-pI(-)_Isosteric_A _L368D/K370S/M428L/N434S

SEQ ID NO: 882 - protein, 220 aa, Artificial Sequence; identical to SEQ ID NO: 545
  Description of Artificial Sequence: Synthetic polypeptide
  XENC1066 Chain 3 - [alphaFAP]_L0.19

SEQ ID NO: 883 - protein, 453 aa, Artificial Sequence; identical to SEQ ID NO: 649
  Description of Artificial Sequence: Synthetic polypeptide
  XENC1067 Chain 1 - [alphaFAP]_H0.26_IgG1 _C220S/S364K/E357Q/M428L/N434S

SEQ ID NO: 884 - protein, 623 aa, Artificial Sequence; identical to SEQ ID NO: 740
  Description of Artificial Sequence: Synthetic polypeptide
  XENC1067 Chain 2 - [alphaFAP]_H0.26_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S

SEQ ID NO: 885 - protein, 220 aa, Artificial Sequence; identical to SEQ ID NO: 545
  Description of Artificial Sequence: Synthetic polypeptide
  XENC1067 Chain 3 - [alphaFAP]_L0.19

SEQ ID NO: 886 - protein, 450 aa, Artificial Sequence; identical to SEQ ID NO: 315
  Description of Artificial Sequence: Synthetic polypeptide
  XENP25189 Chain 1 -  1A7B5[FAP]_H1_IgG1_C220S/S364K/E357Q

SEQ ID NO: 887 - protein, 620 aa, Artificial Sequence
  Description of Artificial Sequence: Synthetic polypeptide
  XENP25189 Chain 2 -  1A7B5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 888 - protein, 214 aa, Artificial Sequence; identical to SEQ ID NO: 260
  Description of Artificial Sequence: Synthetic polypeptide
  XENP25189 Chain 3 -  1A7B5[FAP]_L1

SEQ ID NO: 889 - protein, 450 aa, Artificial Sequence; identical to SEQ ID NO: 315
  Description of Artificial Sequence: Synthetic polypeptide
  XENP25195 Chain 1 -  1A7B5[FAP]_H1_IgG1_C220S/S364K/E357Q

SEQ ID NO: 890 - protein, 620 aa, Artificial Sequence
  Description of Artificial Sequence: Synthetic polypeptide
  XENP25195 Chain 2 -  1A7B5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 891 - protein, 214 aa, Artificial Sequence; identical to SEQ ID NO: 260
  Description of Artificial Sequence: Synthetic polypeptide
  XENP25195 Chain 3 -  1A7B5[FAP]_L1

SEQ ID NO: 892 - protein, 450 aa, Artificial Sequence; identical to SEQ ID NO: 315
  Description of Artificial Sequence: Synthetic polypeptide
  XENC1068 Chain 1 -  1A7B5[FAP]_H1_IgG1_C220S/S364K/E357Q

SEQ ID NO: 893 - protein, 620 aa, Artificial Sequence
  Description of Artificial Sequence: Synthetic polypeptide
  XENC1068 Chain 2 -  1A7B5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 894 - protein, 214 aa, Artificial Sequence; identical to SEQ ID NO: 260
  Description of Artificial Sequence: Synthetic polypeptide
  XENC1068 Chain 3 -  1A7B5[FAP]_L1

SEQ ID NO: 895 - protein, 450 aa, Artificial Sequence; identical to SEQ ID NO: 315
  Description of Artificial Sequence: Synthetic polypeptide
  XENC1069 Chain 1 -  1A7B5[FAP]_H1_IgG1_C220S/S364K/E357Q

SEQ ID NO: 896 - protein, 620 aa, Artificial Sequence
  Description of Artificial Sequence: Synthetic polypeptide
  XENC1069 Chain 2 -  1A7B5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 897 - protein, 214 aa, Artificial Sequence; identical to SEQ ID NO: 260
  Description of Artificial Sequence: Synthetic polypeptide
  XENC1069 Chain 3 -  1A7B5[FAP]_L1

SEQ ID NO: 898 - protein, 450 aa, Artificial Sequence; identical to SEQ ID NO: 315
  Description of Artificial Sequence: Synthetic polypeptide
  XENC1070 Chain 1 -  1A7B5[FAP]_H1_IgG1_C220S/S364K/E357Q

SEQ ID NO: 899 - protein, 620 aa, Artificial Sequence
  Description of Artificial Sequence: Synthetic polypeptide
  XENC1070 Chain 2 -  1A7B5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 900 - protein, 214 aa, Artificial Sequence; identical to SEQ ID NO: 260
  Description of Artificial Sequence: Synthetic polypeptide
  XENC1070 Chain 3 -  1A7B5[FAP]_L1

SEQ ID NO: 901 - protein, 450 aa, Artificial Sequence; identical to SEQ ID NO: 315
  Description of Artificial Sequence: Synthetic polypeptide
  XENC1071 Chain 1 -  1A7B5[FAP]_H1_IgG1_C220S/S364K/E357Q

SEQ ID NO: 902 - protein, 620 aa, Artificial Sequence
  Description of Artificial Sequence: Synthetic polypeptide
  XENC1071 Chain 2 -  1A7B5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 903 - protein, 214 aa, Artificial Sequence; identical to SEQ ID NO: 260
  Description of Artificial Sequence: Synthetic polypeptide
  XENC1071 Chain 3 -  1A7B5[FAP]_L1

SEQ ID NO: 904 - protein, 450 aa, Artificial Sequence; identical to SEQ ID NO: 315
  Description of Artificial Sequence: Synthetic polypeptide
  XENC1072 Chain 1 -  1A7B5[FAP]_H1_IgG1_C220S/S364K/E357Q

SEQ ID NO: 905 - protein, 620 aa, Artificial Sequence
  Description of Artificial Sequence: Synthetic polypeptide
  XENC1072 Chain 2 -  1A7B5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 906 - protein, 214 aa, Artificial Sequence; identical to SEQ ID NO: 260
  Description of Artificial Sequence: Synthetic polypeptide
  XENC1072 Chain 3 -  1A7B5[FAP]_L1

SEQ ID NO: 907 - protein, 450 aa, Artificial Sequence; identical to SEQ ID NO: 315
  Description of Artificial Sequence: Synthetic polypeptide
  XENC1073 Chain 1 -  1A7B5[FAP]_H1_IgG1_C220S/S364K/E357Q

SEQ ID NO: 908 - protein, 620 aa, Artificial Sequence
  Description of Artificial Sequence: Synthetic polypeptide
  XENC1073 Chain 2 -  1A7B5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 909 - protein, 214 aa, Artificial Sequence; identical to SEQ ID NO: 260
  Description of Artificial Sequence: Synthetic polypeptide
  XENC1073 Chain 3 -  1A7B5[FAP]_L1

SEQ ID NO: 910 - protein, 450 aa, Artificial Sequence; identical to SEQ ID NO: 315
  Description of Artificial Sequence: Synthetic polypeptide
  XENC1074 Chain 1 -  1A7B5[FAP]_H1_IgG1_C220S/S364K/E357Q

SEQ ID NO: 911 - protein, 620 aa, Artificial Sequence
  Description of Artificial Sequence: Synthetic polypeptide
  XENC1074 Chain 2 -  1A7B5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 912 - protein, 214 aa, Artificial Sequence; identical to SEQ ID NO: 260
  Description of Artificial Sequence: Synthetic polypeptide
  XENC1074 Chain 3 -  1A7B5[FAP]_L1

SEQ ID NO: 913 - protein, 450 aa, Artificial Sequence; identical to SEQ ID NO: 315
  Description of Artificial Sequence: Synthetic polypeptide
  XENC1075 Chain 1 -  1A7B5[FAP]_H1_IgG1_C220S/S364K/E357Q

SEQ ID NO: 914 - protein, 620 aa, Artificial Sequence
  Description of Artificial Sequence: Synthetic polypeptide
  XENC1075 Chain 2 -  1A7B5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 214 aa, Artificial Sequence; identical to SEQ ID NO: 260
  Description of Artificial Sequence: Synthetic polypeptide
  XENC1075 Chain 3 -  1A7B5[FAP]_L1

SEQ ID NO: 916 - protein, 450 aa, Artificial Sequence; identical to SEQ ID NO: 315
  Description of Artificial Sequence: Synthetic polypeptide
  XENC1076 Chain 1 -  1A7B5[FAP]_H1_IgG1_C220S/S364K/E357Q

SEQ ID NO: 917 - protein, 620 aa, Artificial Sequence
  Description of Artificial Sequence: Synthetic polypeptide
  XENC1076 Chain 2 -  1A7B5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 918 - protein, 214 aa, Artificial Sequence; identical to SEQ ID NO: 260
  Description of Artificial Sequence: Synthetic polypeptide
  XENC1076 Chain 3 -  1A7B5[FAP]_L1

SEQ ID NO: 919 - protein, 450 aa, Artificial Sequence; identical to SEQ ID NO: 315
  Description of Artificial Sequence: Synthetic polypeptide
  XENC1077 Chain 1 -  1A7B5[FAP]_H1_IgG1_C220S/S364K/E357Q

SEQ ID NO: 920 - protein, 620 aa, Artificial Sequence
  Description of Artificial Sequence: Synthetic polypeptide
  XENC1077 Chain 2 -  1A7B5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 921 - protein, 214 aa, Artificial Sequence; identical to SEQ ID NO: 260
  Description of Artificial Sequence: Synthetic polypeptide
  XENC1077 Chain 3 -  1A7B5[FAP]_L1

SEQ ID NO: 922 - protein, 450 aa, Artificial Sequence; identical to SEQ ID NO: 664
  Description of Artificial Sequence: Synthetic polypeptide
  XENC1078 Chain 1 -  1A7B5[FAP]_H1_IgG1 _C220S/S364K/E357Q/M428L/N434S

SEQ ID NO: 923 - protein, 620 aa, Artificial Sequence
  Description of Artificial Sequence: Synthetic polypeptide
  XENC1078 Chain 2 -  1A7B5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 924 - protein, 214 aa, Artificial Sequence; identical to SEQ ID NO: 260
  Description of Artificial Sequence: Synthetic polypeptide
  XENC1078 Chain 3 -  1A7B5[FAP]_L1

SEQ ID NO: 925 - protein, 450 aa, Artificial Sequence; identical to SEQ ID NO: 664
  Description of Artificial Sequence: Synthetic polypeptide
  XENC1079 Chain 1 -  1A7B5[FAP]_H1_IgG1 _C220S/S364K/E357Q/M428L/N434S

SEQ ID NO: 926 - protein, 620 aa, Artificial Sequence
  Description of Artificial Sequence: Synthetic polypeptide
  XENC1079 Chain 2 -  1A7B5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 927 - protein, 214 aa, Artificial Sequence; identical to SEQ ID NO: 260
  Description of Artificial Sequence: Synthetic polypeptide
  XENC1079 Chain 3 -  1A7B5[FAP]_L1

SEQ ID NO: 928 - protein, 450 aa, Artificial Sequence; identical to SEQ ID NO: 664
  Description of Artificial Sequence: Synthetic polypeptide
  XENC1080 Chain 1 -  1A7B5[FAP]_H1_IgG1 _C220S/S364K/E357Q/M428L/N434S

SEQ ID NO: 929 - protein, 620 aa, Artificial Sequence
  Description of Artificial Sequence: Synthetic polypeptide
  XENC1080 Chain 2 -  1A7B5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 930 - protein, 214 aa, Artificial Sequence; identical to SEQ ID NO: 260
  Description of Artificial Sequence: Synthetic polypeptide
  XENC1080 Chain 3 -  1A7B5[FAP]_L1

SEQ ID NO: 931 - protein, 450 aa, Artificial Sequence; identical to SEQ ID NO: 664
  Description of Artificial Sequence: Synthetic polypeptide
  XENC1081 Chain 1 -  1A7B5[FAP]_H1_IgG1 _C220S/S364K/E357Q/M428L/N434S

SEQ ID NO: 932 - protein, 620 aa, Artificial Sequence
  Description of Artificial Sequence: Synthetic polypeptide
  XENC1081 Chain 2 -  1A7B5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 933 - protein, 214 aa, Artificial Sequence; identical to SEQ ID NO: 260
  Description of Artificial Sequence: Synthetic polypeptide
  XENC1081 Chain 3 -  1A7B5[FAP]_L1

SEQ ID NO: 934 - protein, 450 aa, Artificial Sequence; identical to SEQ ID NO: 664
  Description of Artificial Sequence: Synthetic polypeptide
  XENC1082 Chain 1 -  1A7B5[FAP]_H1_IgG1 _C220S/S364K/E357Q/M428L/N434S

SEQ ID NO: 935 - protein, 620 aa, Artificial Sequence
  Description of Artificial Sequence: Synthetic polypeptide
  XENC1082 Chain 2 -  1A7B5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 936 - protein, 214 aa, Artificial Sequence; identical to SEQ ID NO: 260
  Description of Artificial Sequence: Synthetic polypeptide
  XENC1082 Chain 3 -  1A7B5[FAP]_L1

SEQ ID NO: 937 - protein, 450 aa, Artificial Sequence; identical to SEQ ID NO: 664
  Description of Artificial Sequence: Synthetic polypeptide
  XENC1083 Chain 1 -  1A7B5[FAP]_H1_IgG1 _C220S/S364K/E357Q/M428L/N434S

SEQ ID NO: 938 - protein, 620 aa, Artificial Sequence
  Description of Artificial Sequence: Synthetic polypeptide
  XENC1083 Chain 2 -  1A7B5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 939 - protein, 214 aa, Artificial Sequence; identical to SEQ ID NO: 260
  Description of Artificial Sequence: Synthetic polypeptide
  XENC1083 Chain 3 -  1A7B5[FAP]_L1

SEQ ID NO: 940 - protein, 450 aa, Artificial Sequence; identical to SEQ ID NO: 664
  Description of Artificial Sequence: Synthetic polypeptide
  XENC1084 Chain 1 -  1A7B5[FAP]_H1_IgG1 _C220S/S364K/E357Q/M428L/N434S

SEQ ID NO: 941 - protein, 620 aa, Artificial Sequence
  Description of Artificial Sequence: Synthetic polypeptide
  XENC1084 Chain 2 -  1A7B5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 942 - protein, 214 aa, Artificial Sequence; identical to SEQ ID NO: 260
  Description of Artificial Sequence: Synthetic polypeptide
  XENC1084 Chain 3 -  1A7B5[FAP]_L1

SEQ ID NO: 943 - protein, 450 aa, Artificial Sequence; identical to SEQ ID NO: 664
  Description of Artificial Sequence: Synthetic polypeptide
  XENC1085 Chain 1 -  1A7B5[FAP]_H1_IgG1 _C220S/S364K/E357Q/M428L/N434S

SEQ ID NO: 944 - protein, 620 aa, Artificial Sequence
  Description of Artificial Sequence: Synthetic polypeptide
  XENC1085 Chain 2 -  1A7B5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 945 - protein, 214 aa, Artificial Sequence; identical to SEQ ID NO: 260
  Description of Artificial Sequence: Synthetic polypeptide
  XENC1085 Chain 3 -  1A7B5[FAP]_L1

SEQ ID NO: 946 - protein, 450 aa, Artificial Sequence; identical to SEQ ID NO: 664
  Description of Artificial Sequence: Synthetic polypeptide
  XENC1086 Chain 1 -  1A7B5[FAP]_H1_IgG1 _C220S/S364K/E357Q/M428L/N434S

SEQ ID NO: 947 - protein, 620 aa, Artificial Sequence
  Description of Artificial Sequence: Synthetic polypeptide
  XENC1086 Chain 2 -  1A7B5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 948 - protein, 214 aa, Artificial Sequence; identical to SEQ ID NO: 260
  Description of Artificial Sequence: Synthetic polypeptide
  XENC1086 Chain 3 -  1A7B5[FAP]_L1

SEQ ID NO: 949 - protein, 450 aa, Artificial Sequence; identical to SEQ ID NO: 664
  Description of Artificial Sequence: Synthetic polypeptide
  XENC1087 Chain 1 -  1A7B5[FAP]_H1_IgG1 _C220S/S364K/E357Q/M428L/N434S

SEQ ID NO: 950 - protein, 620 aa, Artificial Sequence
  Description of Artificial Sequence: Synthetic polypeptide
  XENC1087 Chain 2 -  1A7B5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 951 - protein, 214 aa, Artificial Sequence; identical to SEQ ID NO: 260
  Description of Artificial Sequence: Synthetic polypeptide
  XENC1087 Chain 3 -  1A7B5[FAP]_L1

SEQ ID NO: 952 - protein, 450 aa, Artificial Sequence; identical to SEQ ID NO: 664
  Description of Artificial Sequence: Synthetic polypeptide
  XENC1088 Chain 1 -  1A7B5[FAP]_H1_IgG1 _C220S/S364K/E357Q/M428L/N434S

SEQ ID NO: 953 - protein, 620 aa, Artificial Sequence
  Description of Artificial Sequence: Synthetic polypeptide
  XENC1088 Chain 2 -  1A7B5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 954 - protein, 214 aa, Artificial Sequence; identical to SEQ ID NO: 260
  Description of Artificial Sequence: Synthetic polypeptide
  XENC1088 Chain 3 -  1A7B5[FAP]_L1

SEQ ID NO: 955 - protein, 450 aa, Artificial Sequence; identical to SEQ ID NO: 664
  Description of Artificial Sequence: Synthetic polypeptide
  XENC1089 Chain 1 -  1A7B5[FAP]_H1_IgG1 _C220S/S364K/E357Q/M428L/N434S

SEQ ID NO: 956 - protein, 620 aa, Artificial Sequence
  Description of Artificial Sequence: Synthetic polypeptide
  XENC1089 Chain 2 -  1A7B5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGGGGSTYYADSVKGRFTISRDNSKNTLYLQMNSLRAEDTAVYYCAKIAHSRIGWHFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 957 - protein, 214 aa, Artificial Sequence; identical to SEQ ID NO: 260
  Description of Artificial Sequence: Synthetic polypeptide
  XENC1089 Chain 3 -  1A7B5[FAP]_L1

SEQ ID NO: 958 - protein, 450 aa, Artificial Sequence; identical to SEQ ID NO: 312
  Description of Artificial Sequence: Synthetic polypeptide
  XENP25966 Chain 1 -  1E5A5[FAP]_H1_IgG1_C220S/S364K/E357Q

SEQ ID NO: 959 - protein, 620 aa, Artificial Sequence
  Description of Artificial Sequence: Synthetic polypeptide
  XENP25966 Chain 2 -  1E5A5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 960 - protein, 214 aa, Artificial Sequence; identical to SEQ ID NO: 258
  Description of Artificial Sequence: Synthetic polypeptide
  XENP25966 Chain 3 -  1E5A5[FAP]_L1

SEQ ID NO: 961 - protein, 450 aa, Artificial Sequence; identical to SEQ ID NO: 312
  Description of Artificial Sequence: Synthetic polypeptide
  XENP25967 Chain 1 -  1E5A5[FAP]_H1_IgG1_C220S/S364K/E357Q

SEQ ID NO: 962 - protein, 620 aa, Artificial Sequence
  Description of Artificial Sequence: Synthetic polypeptide
  XENP25967 Chain 2 -  1E5A5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 963 - protein, 214 aa, Artificial Sequence; identical to SEQ ID NO: 258
  Description of Artificial Sequence: Synthetic polypeptide
  XENP25967 Chain 3 -  1E5A5[FAP]_L1

SEQ ID NO: 964 - protein, 450 aa, Artificial Sequence; identical to SEQ ID NO: 312
  Description of Artificial Sequence: Synthetic polypeptide
  XENC1090 Chain 1 -  1E5A5[FAP]_H1_IgG1_C220S/S364K/E357Q

SEQ ID NO: 965 - protein, 620 aa, Artificial Sequence
  Description of Artificial Sequence: Synthetic polypeptide
  XENC1090 Chain 2 -  1E5A5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 966 - protein, 214 aa, Artificial Sequence; identical to SEQ ID NO: 258
  Description of Artificial Sequence: Synthetic polypeptide
  XENC1090 Chain 3 -  1E5A5[FAP]_L1

SEQ ID NO: 967 - protein, 450 aa, Artificial Sequence; identical to SEQ ID NO: 312
  Description of Artificial Sequence: Synthetic polypeptide
  XENC1091 Chain 1 -  1E5A5[FAP]_H1_IgG1_C220S/S364K/E357Q

SEQ ID NO: 968 - protein, 620 aa, Artificial Sequence
  Description of Artificial Sequence: Synthetic polypeptide
  XENC1091 Chain 2 -  1E5A5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 969 - protein, 214 aa, Artificial Sequence; identical to SEQ ID NO: 258
  Description of Artificial Sequence: Synthetic polypeptide
  XENC1091 Chain 3 -  1E5A5[FAP]_L1

SEQ ID NO: 970 - protein, 450 aa, Artificial Sequence; identical to SEQ ID NO: 312
  Description of Artificial Sequence: Synthetic polypeptide
  XENC1092 Chain 1 -  1E5A5[FAP]_H1_IgG1_C220S/S364K/E357Q

SEQ ID NO: 971 - protein, 620 aa, Artificial Sequence
  Description of Artificial Sequence: Synthetic polypeptide
  XENC1092 Chain 2 -  1E5A5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 972 - protein, 214 aa, Artificial Sequence; identical to SEQ ID NO: 258
  Description of Artificial Sequence: Synthetic polypeptide
  XENC1092 Chain 3 -  1E5A5[FAP]_L1

SEQ ID NO: 973 - protein, 450 aa, Artificial Sequence; identical to SEQ ID NO: 312
  Description of Artificial Sequence: Synthetic polypeptide
  XENC1093 Chain 1 -  1E5A5[FAP]_H1_IgG1_C220S/S364K/E357Q

SEQ ID NO: 974 - protein, 620 aa, Artificial Sequence
  Description of Artificial Sequence: Synthetic polypeptide
  XENC1093 Chain 2 -  1E5A5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 975 - protein, 214 aa, Artificial Sequence; identical to SEQ ID NO: 258
  Description of Artificial Sequence: Synthetic polypeptide
  XENC1093 Chain 3 -  1E5A5[FAP]_L1

SEQ ID NO: 976 - protein, 450 aa, Artificial Sequence; identical to SEQ ID NO: 312
  Description of Artificial Sequence: Synthetic polypeptide
  XENC1094 Chain 1 -  1E5A5[FAP]_H1_IgG1_C220S/S364K/E357Q

SEQ ID NO: 977 - protein, 620 aa, Artificial Sequence
  Description of Artificial Sequence: Synthetic polypeptide
  XENC1094 Chain 2 -  1E5A5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 978 - protein, 214 aa, Artificial Sequence; identical to SEQ ID NO: 258
  Description of Artificial Sequence: Synthetic polypeptide
  XENC1094 Chain 3 -  1E5A5[FAP]_L1

SEQ ID NO: 979 - protein, 450 aa, Artificial Sequence; identical to SEQ ID NO: 312
  Description of Artificial Sequence: Synthetic polypeptide
  XENC1095 Chain 1 -  1E5A5[FAP]_H1_IgG1_C220S/S364K/E357Q

SEQ ID NO: 980 - protein, 620 aa, Artificial Sequence
  Description of Artificial Sequence: Synthetic polypeptide
  XENC1095 Chain 2 -  1E5A5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 981 - protein, 214 aa, Artificial Sequence; identical to SEQ ID NO: 258
  Description of Artificial Sequence: Synthetic polypeptide
  XENC1095 Chain 3 -  1E5A5[FAP]_L1

SEQ ID NO: 982 - protein, 450 aa, Artificial Sequence; identical to SEQ ID NO: 312
  Description of Artificial Sequence: Synthetic polypeptide
  XENC1096 Chain 1 -  1E5A5[FAP]_H1_IgG1_C220S/S364K/E357Q

SEQ ID NO: 983 - protein, 620 aa, Artificial Sequence
  Description of Artificial Sequence: Synthetic polypeptide
  XENC1096 Chain 2 -  1E5A5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 984 - protein, 214 aa, Artificial Sequence; identical to SEQ ID NO: 258
  Description of Artificial Sequence: Synthetic polypeptide
  XENC1096 Chain 3 -  1E5A5[FAP]_L1

SEQ ID NO: 985 - protein, 450 aa, Artificial Sequence; identical to SEQ ID NO: 312
  Description of Artificial Sequence: Synthetic polypeptide
  XENC1097 Chain 1 -  1E5A5[FAP]_H1_IgG1_C220S/S364K/E357Q

SEQ ID NO: 986 - protein, 620 aa, Artificial Sequence
  Description of Artificial Sequence: Synthetic polypeptide
  XENC1097 Chain 2 -  1E5A5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 987 - protein, 214 aa, Artificial Sequence; identical to SEQ ID NO: 258
  Description of Artificial Sequence: Synthetic polypeptide
  XENC1097 Chain 3 -  1E5A5[FAP]_L1

SEQ ID NO: 988 - protein, 450 aa, Artificial Sequence; identical to SEQ ID NO: 312
  Description of Artificial Sequence: Synthetic polypeptide
  XENC1098 Chain 1 -  1E5A5[FAP]_H1_IgG1_C220S/S364K/E357Q

SEQ ID NO: 989 - protein, 620 aa, Artificial Sequence
  Description of Artificial Sequence: Synthetic polypeptide
  XENC1098 Chain 2 -  1E5A5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 990 - protein, 214 aa, Artificial Sequence; identical to SEQ ID NO: 258
  Description of Artificial Sequence: Synthetic polypeptide
  XENC1098 Chain 3 -  1E5A5[FAP]_L1

SEQ ID NO: 991 - protein, 450 aa, Artificial Sequence; identical to SEQ ID NO: 312
  Description of Artificial Sequence: Synthetic polypeptide
  XENC1099 Chain 1 -  1E5A5[FAP]_H1_IgG1_C220S/S364K/E357Q

SEQ ID NO: 992 - protein, 620 aa, Artificial Sequence
  Description of Artificial Sequence: Synthetic polypeptide
  XENC1099 Chain 2 -  1E5A5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 993 - protein, 214 aa, Artificial Sequence; identical to SEQ ID NO: 258
  Description of Artificial Sequence: Synthetic polypeptide
  XENC1099 Chain 3 -  1E5A5[FAP]_L1

SEQ ID NO: 994 - protein, 450 aa, Artificial Sequence; identical to SEQ ID NO: 661
  Description of Artificial Sequence: Synthetic polypeptide
  XENC1100 Chain 1 -  1E5A5[FAP]_H1_IgG1 _C220S/S364K/E357Q/M428L/N434S

SEQ ID NO: 995 - protein, 620 aa, Artificial Sequence
  Description of Artificial Sequence: Synthetic polypeptide
  XENC1100 Chain 2 -  1E5A5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 996 - protein, 214 aa, Artificial Sequence; identical to SEQ ID NO: 258
  Description of Artificial Sequence: Synthetic polypeptide
  XENC1100 Chain 3 -  1E5A5[FAP]_L1

SEQ ID NO: 997 - protein, 450 aa, Artificial Sequence; identical to SEQ ID NO: 661
  Description of Artificial Sequence: Synthetic polypeptide
  XENC1101 Chain 1 -  1E5A5[FAP]_H1_IgG1 _C220S/S364K/E357Q/M428L/N434S

SEQ ID NO: 998 - protein, 620 aa, Artificial Sequence
  Description of Artificial Sequence: Synthetic polypeptide
  XENC1101 Chain 2 -  1E5A5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 999 - protein, 214 aa, Artificial Sequence; identical to SEQ ID NO: 258
  Description of Artificial Sequence: Synthetic polypeptide
  XENC1101 Chain 3 -  1E5A5[FAP]_L1

SEQ ID NO: 1000 - protein, 450 aa, Artificial Sequence; identical to SEQ ID NO: 661
  Description of Artificial Sequence: Synthetic polypeptide
  XENC1102 Chain 1 -  1E5A5[FAP]_H1_IgG1 _C220S/S364K/E357Q/M428L/N434S

SEQ ID NO: 1001 - protein, 620 aa, Artificial Sequence
  Description of Artificial Sequence: Synthetic polypeptide
  XENC1102 Chain 2 -  1E5A5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1002 - protein, 214 aa, Artificial Sequence; identical to SEQ ID NO: 258
  Description of Artificial Sequence: Synthetic polypeptide
  XENC1102 Chain 3 -  1E5A5[FAP]_L1

SEQ ID NO: 1003 - protein, 450 aa, Artificial Sequence; identical to SEQ ID NO: 661
  Description of Artificial Sequence: Synthetic polypeptide
  XENC1103 Chain 1 -  1E5A5[FAP]_H1_IgG1 _C220S/S364K/E357Q/M428L/N434S

SEQ ID NO: 1004 - protein, 620 aa, Artificial Sequence
  Description of Artificial Sequence: Synthetic polypeptide
  XENC1103 Chain 2 -  1E5A5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1005 - protein, 214 aa, Artificial Sequence; identical to SEQ ID NO: 258
  Description of Artificial Sequence: Synthetic polypeptide
  XENC1103 Chain 3 -  1E5A5[FAP]_L1

SEQ ID NO: 1006 - protein, 450 aa, Artificial Sequence; identical to SEQ ID NO: 661
  Description of Artificial Sequence: Synthetic polypeptide
  XENC1104 Chain 1 -  1E5A5[FAP]_H1_IgG1 _C220S/S364K/E357Q/M428L/N434S

SEQ ID NO: 1007 - protein, 620 aa, Artificial Sequence
  Description of Artificial Sequence: Synthetic polypeptide
  XENC1104 Chain 2 -  1E5A5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1008 - protein, 214 aa, Artificial Sequence; identical to SEQ ID NO: 258
  Description of Artificial Sequence: Synthetic polypeptide
  XENC1104 Chain 3 -  1E5A5[FAP]_L1

SEQ ID NO: 1009 - protein, 450 aa, Artificial Sequence; identical to SEQ ID NO: 661
  Description of Artificial Sequence: Synthetic polypeptide
  XENC1105 Chain 1 -  1E5A5[FAP]_H1_IgG1 _C220S/S364K/E357Q/M428L/N434S

SEQ ID NO: 1010 - protein, 620 aa, Artificial Sequence
  Description of Artificial Sequence: Synthetic polypeptide
  XENC1105 Chain 2 -  1E5A5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1011 - protein, 214 aa, Artificial Sequence; identical to SEQ ID NO: 258
  Description of Artificial Sequence: Synthetic polypeptide
  XENC1105 Chain 3 -  1E5A5[FAP]_L1

SEQ ID NO: 1012 - protein, 450 aa, Artificial Sequence; identical to SEQ ID NO: 661
  Description of Artificial Sequence: Synthetic polypeptide
  XENC1106 Chain 1 -  1E5A5[FAP]_H1_IgG1 _C220S/S364K/E357Q/M428L/N434S

SEQ ID NO: 1013 - protein, 620 aa, Artificial Sequence
  Description of Artificial Sequence: Synthetic polypeptide
  XENC1106 Chain 2 -  1E5A5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1014 - protein, 214 aa, Artificial Sequence; identical to SEQ ID NO: 258
  Description of Artificial Sequence: Synthetic polypeptide
  XENC1106 Chain 3 -  1E5A5[FAP]_L1

SEQ ID NO: 1015 - protein, 450 aa, Artificial Sequence; identical to SEQ ID NO: 661
  Description of Artificial Sequence: Synthetic polypeptide
  XENC1107 Chain 1 -  1E5A5[FAP]_H1_IgG1 _C220S/S364K/E357Q/M428L/N434S

SEQ ID NO: 1016 - protein, 620 aa, Artificial Sequence
  Description of Artificial Sequence: Synthetic polypeptide
  XENC1107 Chain 2 -  1E5A5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1017 - protein, 214 aa, Artificial Sequence; identical to SEQ ID NO: 258
  Description of Artificial Sequence: Synthetic polypeptide
  XENC1107 Chain 3 -  1E5A5[FAP]_L1

SEQ ID NO: 1018 - protein, 450 aa, Artificial Sequence; identical to SEQ ID NO: 661
  Description of Artificial Sequence: Synthetic polypeptide
  XENC1108 Chain 1 -  1E5A5[FAP]_H1_IgG1 _C220S/S364K/E357Q/M428L/N434S

SEQ ID NO: 1019 - protein, 620 aa, Artificial Sequence
  Description of Artificial Sequence: Synthetic polypeptide
  XENC1108 Chain 2 -  1E5A5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1020 - protein, 214 aa, Artificial Sequence; identical to SEQ ID NO: 258
  Description of Artificial Sequence: Synthetic polypeptide
  XENC1108 Chain 3 -  1E5A5[FAP]_L1

SEQ ID NO: 1021 - protein, 450 aa, Artificial Sequence; identical to SEQ ID NO: 661
  Description of Artificial Sequence: Synthetic polypeptide
  XENC1109 Chain 1 -  1E5A5[FAP]_H1_IgG1 _C220S/S364K/E357Q/M428L/N434S

SEQ ID NO: 1022 - protein, 620 aa, Artificial Sequence
  Description of Artificial Sequence: Synthetic polypeptide
  XENC1109 Chain 2 -  1E5A5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1023 - protein, 214 aa, Artificial Sequence; identical to SEQ ID NO: 258
  Description of Artificial Sequence: Synthetic polypeptide
  XENC1109 Chain 3 -  1E5A5[FAP]_L1

SEQ ID NO: 1024 - protein, 450 aa, Artificial Sequence; identical to SEQ ID NO: 661
  Description of Artificial Sequence: Synthetic polypeptide
  XENC1110 Chain 1 -  1E5A5[FAP]_H1_IgG1 _C220S/S364K/E357Q/M428L/N434S

SEQ ID NO: 1025 - protein, 620 aa, Artificial Sequence
  Description of Artificial Sequence: Synthetic polypeptide
  XENC1110 Chain 2 -  1E5A5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1026 - protein, 214 aa, Artificial Sequence; identical to SEQ ID NO: 258
  Description of Artificial Sequence: Synthetic polypeptide
  XENC1110 Chain 3 -  1E5A5[FAP]_L1

SEQ ID NO: 1027 - protein, 450 aa, Artificial Sequence; identical to SEQ ID NO: 661
  Description of Artificial Sequence: Synthetic polypeptide
  XENC1111 Chain 1 -  1E5A5[FAP]_H1_IgG1 _C220S/S364K/E357Q/M428L/N434S

SEQ ID NO: 1028 - protein, 620 aa, Artificial Sequence
  Description of Artificial Sequence: Synthetic polypeptide
  XENC1111 Chain 2 -  1E5A5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKISFYPGGTYFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1029 - protein, 214 aa, Artificial Sequence; identical to SEQ ID NO: 258
  Description of Artificial Sequence: Synthetic polypeptide
  XENC1111 Chain 3 -  1E5A5[FAP]_L1

SEQ ID NO: 1030 - protein, 450 aa, Artificial Sequence; identical to SEQ ID NO: 312
  Description of Artificial Sequence: Synthetic polypeptide
  XENP25188 Chain 1 -  1E5A5(COMMONLC)[FAP]_H1_IgG1 _C220S/S364K/E357Q

SEQ ID NO: 1031 - protein, 620 aa, Artificial Sequence; identical to SEQ ID NO: 959
  Description of Artificial Sequence: Synthetic polypeptide
  XENP25188 Chain 2 -  1E5A5(COMMONLC)[FAP]_H1_(G4S)2 _[alphaCD3]_H1.30_L1.47_scFv(GKPGS)4_(G4S)2_IgG1_PVA_/ S267K-pI(-)_Isosteric_A_L368D/K370S

SEQ ID NO: 1032 - protein, 214 aa, Artificial Sequence; identical to SEQ ID NO: 260
  Description of Artificial Sequence: Synthetic polypeptide
  XENP25188 Chain 3 -  1E5A5(COMMONLC)[FAP]_L1

SEQ ID NO: 1033 - protein, 450 aa, Artificial Sequence; identical to SEQ ID NO: 312
  Description of Artificial Sequence: Synthetic polypeptide
  XENP25194 Chain 1 -  1E5A5(COMMONLC)[FAP]_H1_IgG1 _C220S/S364K/E357Q

SEQ ID NO: 1034 - protein, 620 aa, Artificial Sequence; identical to SEQ ID NO: 962
  Description of Artificial Sequence: Synthetic polypeptide
  XENP25194 Chain 2 -  1E5A5(COMMONLC)[FAP]_H1_(G4S)2 _[alphaCD3]_H1.32_L1.47_scFv(GKPGS)4_(G4S)2_IgG1_PVA_/ S267K-pI(-)_Isosteric_A_L368D/K370S

SEQ ID NO: 1035 - protein, 214 aa, Artificial Sequence; identical to SEQ ID NO: 260
  Description of Artificial Sequence: Synthetic polypeptide
  XENP25194 Chain 3 -  1E5A5(COMMONLC)[FAP]_L1

SEQ ID NO: 1036 - protein, 450 aa, Artificial Sequence; identical to SEQ ID NO: 312
  Description of Artificial Sequence: Synthetic polypeptide
  XENC1112 Chain 1 -  1E5A5(COMMONLC)[FAP]_H1_IgG1 _C220S/S364K/E357Q

SEQ ID NO: 1037 - protein, 620 aa, Artificial Sequence; identical to SEQ ID NO: 965
  Description of Artificial Sequence: Synthetic polypeptide
  XENC1112 Chain 2 -  1E5A5(COMMONLC)[FAP]_H1_(G4S)2_[alphaCD3] _H1.89_L1.47_scFv(GKPGS)4_(G4S)2_IgG1_PVA_/S267K-pI(-) _Isosteric_A_L368D/K370S

SEQ ID NO: 1038 - protein, 214 aa, Artificial Sequence; identical to SEQ ID NO: 260
  Description of Artificial Sequence: Synthetic polypeptide
  XENC1112 Chain 3 -  1E5A5(COMMONLC)[FAP]_L1

SEQ ID NO: 1039 - protein, 450 aa, Artificial Sequence; identical to SEQ ID NO: 312
  Description of Artificial Sequence: Synthetic polypeptide
  XENC1113 Chain 1 -  1E5A5(COMMONLC)[FAP]_H1_IgG1 _C220S/S364K/E357Q

SEQ ID NO: 1040 - protein, 620 aa, Artificial Sequence; identical to SEQ ID NO: 968
  Description of Artificial Sequence: Synthetic polypeptide
  XENC1113 Chain 2 -  1E5A5(COMMONLC)[FAP]_H1_(G4S)2_[alphaCD3] _H1.90_L1.47_scFv(GKPGS)4_(G4S)2_IgG1_PVA_/S267K-pI(-) _Isosteric_A_L368D/K370S

SEQ ID NO: 1041 - protein, 214 aa, Artificial Sequence; identical to SEQ ID NO: 260
  Description of Artificial Sequence: Synthetic polypeptide
  XENC1113 Chain 3 -  1E5A5(COMMONLC)[FAP]_L1

SEQ ID NO: 1042 - protein, 450 aa, Artificial Sequence; identical to SEQ ID NO: 312
  Description of Artificial Sequence: Synthetic polypeptide
  XENC1114 Chain 1 -  1E5A5(COMMONLC)[FAP]_H1_IgG1 _C220S/S364K/E357Q

SEQ ID NO: 1043 - protein, 620 aa, Artificial Sequence; identical to SEQ ID NO: 971
  Description of Artificial Sequence: Synthetic polypeptide
  XENC1114 Chain 2 -  1E5A5(COMMONLC)[FAP]_H1_(G4S)2_[alphaCD3] _H1.33_L1.47_scFv(GKPGS)4_(G4S)2_IgG1_PVA_/S267K-pI(-) _Isosteric_A_L368D/K370S

SEQ ID NO: 1044 - protein, 214 aa, Artificial Sequence; identical to SEQ ID NO: 260
  Description of Artificial Sequence: Synthetic polypeptide
  XENC1114 Chain 3 -  1E5A5(COMMONLC)[FAP]_L1

SEQ ID NO: 1045 - protein, 450 aa, Artificial Sequence; identical to SEQ ID NO: 312
  Description of Artificial Sequence: Synthetic polypeptide
  XENC1115 Chain 1 -  1E5A5(COMMONLC)[FAP]_H1_IgG1 _C220S/S364K/E357Q

SEQ ID NO: 1046 - protein, 620 aa, Artificial Sequence; identical to SEQ ID NO: 974
  Description of Artificial Sequence: Synthetic polypeptide
  XENC1115 Chain 2 -  1E5A5(COMMONLC)[FAP]_H1_(G4S)2_[alphaCD3] _H1.31_L1.47_scFv(GKPGS)4_(G4S)2_IgG1_PVA_/S267K-pI(-) _Isosteric_A_L368D/K370S

SEQ ID NO: 1047 - protein, 214 aa, Artificial Sequence; identical to SEQ ID NO: 260
  Description of Artificial Sequence: Synthetic polypeptide
  XENC1115 Chain 3 -  1E5A5(COMMONLC)[FAP]_L1

SEQ ID NO: 1048 - protein, 450 aa, Artificial Sequence; identical to SEQ ID NO: 312
  Description of Artificial Sequence: Synthetic polypeptide
  XENC1116 Chain 1 -  1E5A5(COMMONLC)[FAP]_H1_IgG1 _C220S/S364K/E357Q

SEQ ID NO: 1049 - protein, 620 aa, Artificial Sequence; identical to SEQ ID NO: 977
  Description of Artificial Sequence: Synthetic polypeptide
  XENC1116 Chain 2 -  1E5A5(COMMONLC)[FAP]_H1_(G4S)2 _[alphaCD3] _L1.47_H1.30_scFv(GKPGS)4_(G4S)2_IgG1_PVA_/ S267K-pI(-)_Isosteric_A_L368D/K370S

SEQ ID NO: 1050 - protein, 214 aa, Artificial Sequence; identical to SEQ ID NO: 260
  Description of Artificial Sequence: Synthetic polypeptide
  XENC1116 Chain 3 -  1E5A5(COMMONLC)[FAP]_L1

SEQ ID NO: 1051 - protein, 450 aa, Artificial Sequence; identical to SEQ ID NO: 312
  Description of Artificial Sequence: Synthetic polypeptide
  XENC1117 Chain 1 -  1E5A5(COMMONLC)[FAP]_H1_IgG1 _C220S/S364K/E357Q

SEQ ID NO: 1052 - protein, 620 aa, Artificial Sequence; identical to SEQ ID NO: 980
  Description of Artificial Sequence: Synthetic polypeptide
  XENC1117 Chain 2 -  1E5A5(COMMONLC)[FAP]_H1_(G4S)2 _[alphaCD3] _L1.47_H1.32_scFv(GKPGS)4_(G4S)2_IgG1_PVA_/ S267K-pI(-)_Isosteric_A_L368D/K370S

SEQ ID NO: 1053 - protein, 214 aa, Artificial Sequence; identical to SEQ ID NO: 260
  Description of Artificial Sequence: Synthetic polypeptide
  XENC1117 Chain 3 -  1E5A5(COMMONLC)[FAP]_L1

SEQ ID NO: 1054 - protein, 450 aa, Artificial Sequence; identical to SEQ ID NO: 312
  Description of Artificial Sequence: Synthetic polypeptide
  XENC1118 Chain 1 -  1E5A5(COMMONLC)[FAP]_H1_IgG1 _C220S/S364K/E357Q

SEQ ID NO: 1055 - protein, 620 aa, Artificial Sequence; identical to SEQ ID NO: 983
  Description of Artificial Sequence: Synthetic polypeptide
  XENC1118 Chain 2 -  1E5A5(COMMONLC)[FAP]_H1_(G4S)2 _[alphaCD3] _L1.47_H1.89_scFv(GKPGS)4_(G4S)2_IgG1_PVA_/ S267K-pI(-)_Isosteric_A_L368D/K370S

SEQ ID NO: 1056 - protein, 214 aa, Artificial Sequence; identical to SEQ ID NO: 260
  Description of Artificial Sequence: Synthetic polypeptide
  XENC1118 Chain 3 -  1E5A5(COMMONLC)[FAP]_L1

SEQ ID NO: 1057 - protein, 450 aa, Artificial Sequence; identical to SEQ ID NO: 312
  Description of Artificial Sequence: Synthetic polypeptide
  XENC1119 Chain 1 -  1E5A5(COMMONLC)[FAP]_H1_IgG1 _C220S/S364K/E357Q

SEQ ID NO: 1058 - protein, 620 aa, Artificial Sequence; identical to SEQ ID NO: 986
  Description of Artificial Sequence: Synthetic polypeptide
  XENC1119 Chain 2 -  1E5A5(COMMONLC)[FAP]_H1_(G4S)2 _[alphaCD3] _L1.47_H1.90_scFv(GKPGS)4_(G4S)2_IgG1_PVA_/ S267K-pI(-)_Isosteric_A_L368D/K370S

SEQ ID NO: 1059 - protein, 214 aa, Artificial Sequence; identical to SEQ ID NO: 260
  Description of Artificial Sequence: Synthetic polypeptide
  XENC1119 Chain 3 -  1E5A5(COMMONLC)[FAP]_L1

SEQ ID NO: 1060 - protein, 450 aa, Artificial Sequence; identical to SEQ ID NO: 312
  Description of Artificial Sequence: Synthetic polypeptide
  XENC1120 Chain 1 -  1E5A5(COMMONLC)[FAP]_H1_IgG1 _C220S/S364K/E357Q

SEQ ID NO: 1061 - protein, 620 aa, Artificial Sequence; identical to SEQ ID NO: 989
  Description of Artificial Sequence: Synthetic polypeptide
  XENC1120 Chain 2 -  1E5A5(COMMONLC)[FAP]_H1_(G4S)2 _[alphaCD3] _L1.47_H1.33_scFv(GKPGS)4_(G4S)2_IgG1_PVA_/ S267K-pI(-)_Isosteric_A_L368D/K370S

SEQ ID NO: 1062 - protein, 214 aa, Artificial Sequence; identical to SEQ ID NO: 260
  Description of Artificial Sequence: Synthetic polypeptide
  XENC1120 Chain 3 -  1E5A5(COMMONLC)[FAP]_L1

SEQ ID NO: 1063 - protein, 450 aa, Artificial Sequence; identical to SEQ ID NO: 312
  Description of Artificial Sequence: Synthetic polypeptide
  XENC1121 Chain 1 -  1E5A5(COMMONLC)[FAP]_H1_IgG1 _C220S/S364K/E357Q

SEQ ID NO: 1064 - protein, 620 aa, Artificial Sequence; identical to SEQ ID NO: 992
  Description of Artificial Sequence: Synthetic polypeptide
  XENC1121 Chain 2 -  1E5A5(COMMONLC)[FAP]_H1_(G4S)2 _[alphaCD3] _L1.47_H1.31_scFv(GKPGS)4_(G4S)2_IgG1_PVA_/ S267K-pI(-)_Isosteric_A_L368D/K370S

SEQ ID NO: 1065 - protein, 214 aa, Artificial Sequence; identical to SEQ ID NO: 260
  Description of Artificial Sequence: Synthetic polypeptide
  XENC1121 Chain 3 -  1E5A5(COMMONLC)[FAP]_L1

SEQ ID NO: 1066 - protein, 450 aa, Artificial Sequence; identical to SEQ ID NO: 661
  Description of Artificial Sequence: Synthetic polypeptide
  XENC1122 Chain 1 -  1E5A5(COMMONLC)[FAP]_H1_IgG1 _C220S/S364K/E357Q/M428L/N434S

SEQ ID NO: 1067 - protein, 620 aa, Artificial Sequence; identical to SEQ ID NO: 995
  Description of Artificial Sequence: Synthetic polypeptide
  XENC1122 Chain 2 -  1E5A5(COMMONLC)[FAP]_H1_(G4S)2_[alphaCD3] _H1.30_L1.47_scFv(GKPGS)4_(G4S)2_IgG1_PVA_/S267K-pI(-) _Isosteric_A_L368D/K370S/M428L/N434S

SEQ ID NO: 1068 - protein, 214 aa, Artificial Sequence; identical to SEQ ID NO: 260
  Description of Artificial Sequence: Synthetic polypeptide
  XENC1122 Chain 3 -  1E5A5(COMMONLC)[FAP]_L1

SEQ ID NO: 1069 - protein, 450 aa, Artificial Sequence; identical to SEQ ID NO: 661
  Description of Artificial Sequence: Synthetic polypeptide
  XENC1123 Chain 1 -  1E5A5(COMMONLC)[FAP]_H1_IgG1 _C220S/S364K/E357Q/M428L/N434S

SEQ ID NO: 1070 - protein, 620 aa, Artificial Sequence; identical to SEQ ID NO: 998
  Description of Artificial Sequence: Synthetic polypeptide
  XENC1123 Chain 2 -  1E5A5(COMMONLC)[FAP]_H1_(G4S)2_[alphaCD3] _H1.32_L1.47_scFv(GKPGS)4_(G4S)2_IgG1_PVA_/S267K-pI(-) _Isosteric_A_L368D/K370S/M428L/N434S

SEQ ID NO: 1071 - protein, 214 aa, Artificial Sequence; identical to SEQ ID NO: 260
  Description of Artificial Sequence: Synthetic polypeptide
  XENC1123 Chain 3 -  1E5A5(COMMONLC)[FAP]_L1

SEQ ID NO: 1072 - protein, 450 aa, Artificial Sequence; identical to SEQ ID NO: 661
  Description of Artificial Sequence: Synthetic polypeptide
  XENC1124 Chain 1 -  1E5A5(COMMONLC)[FAP]_H1_IgG1 _C220S/S364K/E357Q/M428L/N434S

SEQ ID NO: 1073 - protein, 620 aa, Artificial Sequence; identical to SEQ ID NO: 1001
  Description of Artificial Sequence: Synthetic polypeptide
  XENC1124 Chain 2 -  1E5A5(COMMONLC)[FAP]_H1_(G4S)2_[alphaCD3] _H1.89_L1.47_scFv(GKPGS)4_(G4S)2_IgG1_PVA_/S267K-pI(-) _Isosteric_A_L368D/K370S/M428L/N434S

SEQ ID NO: 1074 - protein, 214 aa, Artificial Sequence; identical to SEQ ID NO: 260
  Description of Artificial Sequence: Synthetic polypeptide
  XENC1124 Chain 3 -  1E5A5(COMMONLC)[FAP]_L1

SEQ ID NO: 1075 - protein, 450 aa, Artificial Sequence; identical to SEQ ID NO: 661
  Description of Artificial Sequence: Synthetic polypeptide
  XENC1125 Chain 1 -  1E5A5(COMMONLC)[FAP]_H1_IgG1 _C220S/S364K/E357Q/M428L/N434S

SEQ ID NO: 1076 - protein, 620 aa, Artificial Sequence; identical to SEQ ID NO: 1004
  Description of Artificial Sequence: Synthetic polypeptide
  XENC1125 Chain 2 -  1E5A5(COMMONLC)[FAP]_H1_(G4S)2_[alphaCD3] _H1.90_L1.47_scFv(GKPGS)4_(G4S)2_IgG1_PVA_/S267K-pI(-) _Isosteric_A_L368D/K370S/M428L/N434S

SEQ ID NO: 1077 - protein, 214 aa, Artificial Sequence; identical to SEQ ID NO: 260
  Description of Artificial Sequence: Synthetic polypeptide
  XENC1125 Chain 3 -  1E5A5(COMMONLC)[FAP]_L1

SEQ ID NO: 1078 - protein, 450 aa, Artificial Sequence; identical to SEQ ID NO: 661
  Description of Artificial Sequence: Synthetic polypeptide
  XENC1126 Chain 1 -  1E5A5(COMMONLC)[FAP]_H1_IgG1 _C220S/S364K/E357Q/M428L/N434S

SEQ ID NO: 1079 - protein, 620 aa, Artificial Sequence; identical to SEQ ID NO: 1007
  Description of Artificial Sequence: Synthetic polypeptide
  XENC1126 Chain 2 -  1E5A5(COMMONLC)[FAP]_H1_(G4S)2_[alphaCD3] _H1.33_L1.47_scFv(GKPGS)4_(G4S)2_IgG1_PVA_/S267K-pI(-) _Isosteric_A_L368D/K370S/M428L/N434S

SEQ ID NO: 1080 - protein, 214 aa, Artificial Sequence; identical to SEQ ID NO: 260
  Description of Artificial Sequence: Synthetic polypeptide
  XENC1126 Chain 3 -  1E5A5(COMMONLC)[FAP]_L1

SEQ ID NO: 1081 - protein, 450 aa, Artificial Sequence; identical to SEQ ID NO: 661
  Description of Artificial Sequence: Synthetic polypeptide
  XENC1127 Chain 1 -  1E5A5(COMMONLC)[FAP]_H1_IgG1 _C220S/S364K/E357Q/M428L/N434S

SEQ ID NO: 1082 - protein, 620 aa, Artificial Sequence; identical to SEQ ID NO: 1010
  Description of Artificial Sequence: Synthetic polypeptide
  XENC1127 Chain 2 -  1E5A5(COMMONLC)[FAP]_H1_(G4S)2_[alphaCD3] _H1.31_L1.47_scFv(GKPGS)4_(G4S)2_IgG1_PVA_/S267K-pI(-) _Isosteric_A_L368D/K370S/M428L/N434S

SEQ ID NO: 1083 - protein, 214 aa, Artificial Sequence; identical to SEQ ID NO: 260
  Description of Artificial Sequence: Synthetic polypeptide
  XENC1127 Chain 3 -  1E5A5(COMMONLC)[FAP]_L1

SEQ ID NO: 1084 - protein, 450 aa, Artificial Sequence; identical to SEQ ID NO: 661
  Description of Artificial Sequence: Synthetic polypeptide
  XENC1128 Chain 1 -  1E5A5(COMMONLC)[FAP]_H1_IgG1 _C220S/S364K/E357Q/M428L/N434S

SEQ ID NO: 1085 - protein, 620 aa, Artificial Sequence; identical to SEQ ID NO: 1013
  Description of Artificial Sequence: Synthetic polypeptide
  XENC1128 Chain 2 -  1E5A5(COMMONLC)[FAP]_H1_(G4S)2 _[alphaCD3] _L1.47_H1.30_scFv(GKPGS)4_(G4S)2_IgG1_PVA_/ S267K-pI(-)_Isosteric_A_L368D/K370S/M428L/N434S

SEQ ID NO: 1086 - protein, 214 aa, Artificial Sequence; identical to SEQ ID NO: 260
  Description of Artificial Sequence: Synthetic polypeptide
  XENC1128 Chain 3 -  1E5A5(COMMONLC)[FAP]_L1

SEQ ID NO: 1087 - protein, 450 aa, Artificial Sequence; identical to SEQ ID NO: 661
  Description of Artificial Sequence: Synthetic polypeptide
  XENC1129 Chain 1 -  1E5A5(COMMONLC)[FAP]_H1_IgG1 _C220S/S364K/E357Q/M428L/N434S

SEQ ID NO: 1088 - protein, 620 aa, Artificial Sequence; identical to SEQ ID NO: 1016
  Description of Artificial Sequence: Synthetic polypeptide
  XENC1129 Chain 2 -  1E5A5(COMMONLC)[FAP]_H1_(G4S)2 _[alphaCD3] _L1.47_H1.32_scFv(GKPGS)4_(G4S)2_IgG1_PVA_/ S267K-pI(-)_Isosteric_A_L368D/K370S/M428L/N434S

SEQ ID NO: 1089 - protein, 214 aa, Artificial Sequence; identical to SEQ ID NO: 260
  Description of Artificial Sequence: Synthetic polypeptide
  XENC1129 Chain 3 -  1E5A5(COMMONLC)[FAP]_L1

SEQ ID NO: 1090 - protein, 450 aa, Artificial Sequence; identical to SEQ ID NO: 661
  Description of Artificial Sequence: Synthetic polypeptide
  XENC1130 Chain 1 -  1E5A5(COMMONLC)[FAP]_H1_IgG1 _C220S/S364K/E357Q/M428L/N434S

SEQ ID NO: 1091 - protein, 620 aa, Artificial Sequence; identical to SEQ ID NO: 1019
  Description of Artificial Sequence: Synthetic polypeptide
  XENC1130 Chain 2 -  1E5A5(COMMONLC)[FAP]_H1_(G4S)2 _[alphaCD3] _L1.47_H1.89_scFv(GKPGS)4_(G4S)2_IgG1_PVA_/ S267K-pI(-)_Isosteric_A_L368D/K370S/M428L/N434S

SEQ ID NO: 1092 - protein, 214 aa, Artificial Sequence; identical to SEQ ID NO: 260
  Description of Artificial Sequence: Synthetic polypeptide
  XENC1130 Chain 3 -  1E5A5(COMMONLC)[FAP]_L1

SEQ ID NO: 1093 - protein, 450 aa, Artificial Sequence; identical to SEQ ID NO: 661
  Description of Artificial Sequence: Synthetic polypeptide
  XENC1131 Chain 1 -  1E5A5(COMMONLC)[FAP]_H1_IgG1 _C220S/S364K/E357Q/M428L/N434S

SEQ ID NO: 1094 - protein, 620 aa, Artificial Sequence; identical to SEQ ID NO: 1022
  Description of Artificial Sequence: Synthetic polypeptide
  XENC1131 Chain 2 -  1E5A5(COMMONLC)[FAP]_H1_(G4S)2 _[alphaCD3] _L1.47_H1.90_scFv(GKPGS)4_(G4S)2_IgG1_PVA_/ S267K-pI(-)_Isosteric_A_L368D/K370S/M428L/N434S

SEQ ID NO: 1095 - protein, 214 aa, Artificial Sequence; identical to SEQ ID NO: 260
  Description of Artificial Sequence: Synthetic polypeptide
  XENC1131 Chain 3 -  1E5A5(COMMONLC)[FAP]_L1

SEQ ID NO: 1096 - protein, 450 aa, Artificial Sequence; identical to SEQ ID NO: 661
  Description of Artificial Sequence: Synthetic polypeptide
  XENC1132 Chain 1 -  1E5A5(COMMONLC)[FAP]_H1_IgG1 _C220S/S364K/E357Q/M428L/N434S

SEQ ID NO: 1097 - protein, 620 aa, Artificial Sequence; identical to SEQ ID NO: 1025
  Description of Artificial Sequence: Synthetic polypeptide
  XENC1132 Chain 2 -  1E5A5(COMMONLC)[FAP]_H1_(G4S)2 _[alphaCD3] _L1.47_H1.33_scFv(GKPGS)4_(G4S)2_IgG1_PVA_/ S267K-pI(-)_Isosteric_A_L368D/K370S/M428L/N434S

SEQ ID NO: 1098 - protein, 214 aa, Artificial Sequence; identical to SEQ ID NO: 260
  Description of Artificial Sequence: Synthetic polypeptide
  XENC1132 Chain 3 -  1E5A5(COMMONLC)[FAP]_L1

SEQ ID NO: 1099 - protein, 450 aa, Artificial Sequence; identical to SEQ ID NO: 661
  Description of Artificial Sequence: Synthetic polypeptide
  XENC1133 Chain 1 -  1E5A5(COMMONLC)[FAP]_H1_IgG1 _C220S/S364K/E357Q/M428L/N434S

SEQ ID NO: 1100 - protein, 620 aa, Artificial Sequence; identical to SEQ ID NO: 1028
  Description of Artificial Sequence: Synthetic polypeptide
  XENC1133 Chain 2 -  1E5A5(COMMONLC)[FAP]_H1_(G4S)2 _[alphaCD3] _L1.47_H1.31_scFv(GKPGS)4_(G4S)2_IgG1_PVA_/ S267K-pI(-)_Isosteric_A_L368D/K370S/M428L/N434S

SEQ ID NO: 1101 - protein, 214 aa, Artificial Sequence; identical to SEQ ID NO: 260
  Description of Artificial Sequence: Synthetic polypeptide
  XENC1133 Chain 3 -  1E5A5(COMMONLC)[FAP]_L1

SEQ ID NO: 1102 - protein, 450 aa, Artificial Sequence; identical to SEQ ID NO: 318
  Description of Artificial Sequence: Synthetic polypeptide
  XENP25187 Chain 1 -  1F4B5[FAP]_H1_IgG1_C220S/S364K/E357Q

SEQ ID NO: 1103 - protein, 620 aa, Artificial Sequence
  Description of Artificial Sequence: Synthetic polypeptide
  XENP25187 Chain 2 -  1F4B5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1104 - protein, 214 aa, Artificial Sequence; identical to SEQ ID NO: 260
  Description of Artificial Sequence: Synthetic polypeptide
  XENP25187 Chain 3 -  1F4B5[FAP]_L1

SEQ ID NO: 1105 - protein, 450 aa, Artificial Sequence; identical to SEQ ID NO: 318
  Description of Artificial Sequence: Synthetic polypeptide
  XENP25193 Chain 1 -  1F4B5[FAP]_H1_IgG1_C220S/S364K/E357Q

SEQ ID NO: 1106 - protein, 620 aa, Artificial Sequence
  Description of Artificial Sequence: Synthetic polypeptide
  XENP25193 Chain 2 -  1F4B5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1107 - protein, 214 aa, Artificial Sequence; identical to SEQ ID NO: 260
  Description of Artificial Sequence: Synthetic polypeptide
  XENP25193 Chain 3 -  1F4B5[FAP]_L1

SEQ ID NO: 1108 - protein, 450 aa, Artificial Sequence; identical to SEQ ID NO: 318
  Description of Artificial Sequence: Synthetic polypeptide
  XENC1134 Chain 1 -  1F4B5[FAP]_H1_IgG1_C220S/S364K/E357Q

SEQ ID NO: 1109 - protein, 620 aa, Artificial Sequence
  Description of Artificial Sequence: Synthetic polypeptide
  XENC1134 Chain 2 -  1F4B5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1110 - protein, 214 aa, Artificial Sequence; identical to SEQ ID NO: 260
  Description of Artificial Sequence: Synthetic polypeptide
  XENC1134 Chain 3 -  1F4B5[FAP]_L1

SEQ ID NO: 1111 - protein, 450 aa, Artificial Sequence; identical to SEQ ID NO: 318
  Description of Artificial Sequence: Synthetic polypeptide
  XENC1135 Chain 1 -  1F4B5[FAP]_H1_IgG1_C220S/S364K/E357Q

SEQ ID NO: 1112 - protein, 620 aa, Artificial Sequence
  Description of Artificial Sequence: Synthetic polypeptide
  XENC1135 Chain 2 -  1F4B5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1113 - protein, 214 aa, Artificial Sequence; identical to SEQ ID NO: 260
  Description of Artificial Sequence: Synthetic polypeptide
  XENC1135 Chain 3 -  1F4B5[FAP]_L1

SEQ ID NO: 1114 - protein, 450 aa, Artificial Sequence; identical to SEQ ID NO: 318
  Description of Artificial Sequence: Synthetic polypeptide
  XENC1136 Chain 1 -  1F4B5[FAP]_H1_IgG1_C220S/S364K/E357Q

SEQ ID NO: 1115 - protein, 620 aa, Artificial Sequence
  Description of Artificial Sequence: Synthetic polypeptide
  XENC1136 Chain 2 -  1F4B5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1116 - protein, 214 aa, Artificial Sequence; identical to SEQ ID NO: 260
  Description of Artificial Sequence: Synthetic polypeptide
  XENC1136 Chain 3 -  1F4B5[FAP]_L1

SEQ ID NO: 1117 - protein, 450 aa, Artificial Sequence; identical to SEQ ID NO: 318
  Description of Artificial Sequence: Synthetic polypeptide
  XENC1137 Chain 1 -  1F4B5[FAP]_H1_IgG1_C220S/S364K/E357Q

SEQ ID NO: 1118 - protein, 620 aa, Artificial Sequence
  Description of Artificial Sequence: Synthetic polypeptide
  XENC1137 Chain 2 -  1F4B5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1119 - protein, 214 aa, Artificial Sequence; identical to SEQ ID NO: 260
  Description of Artificial Sequence: Synthetic polypeptide
  XENC1137 Chain 3 -  1F4B5[FAP]_L1

SEQ ID NO: 1120 - protein, 450 aa, Artificial Sequence; identical to SEQ ID NO: 318
  Description of Artificial Sequence: Synthetic polypeptide
  XENC1138 Chain 1 -  1F4B5[FAP]_H1_IgG1_C220S/S364K/E357Q

SEQ ID NO: 1121 - protein, 620 aa, Artificial Sequence
  Description of Artificial Sequence: Synthetic polypeptide
  XENC1138 Chain 2 -  1F4B5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1122 - protein, 214 aa, Artificial Sequence; identical to SEQ ID NO: 260
  Description of Artificial Sequence: Synthetic polypeptide
  XENC1138 Chain 3 -  1F4B5[FAP]_L1

SEQ ID NO: 1123 - protein, 450 aa, Artificial Sequence; identical to SEQ ID NO: 318
  Description of Artificial Sequence: Synthetic polypeptide
  XENC1139 Chain 1 -  1F4B5[FAP]_H1_IgG1_C220S/S364K/E357Q

SEQ ID NO: 1124 - protein, 620 aa, Artificial Sequence
  Description of Artificial Sequence: Synthetic polypeptide
  XENC1139 Chain 2 -  1F4B5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1125 - protein, 214 aa, Artificial Sequence; identical to SEQ ID NO: 260
  Description of Artificial Sequence: Synthetic polypeptide
  XENC1139 Chain 3 -  1F4B5[FAP]_L1

SEQ ID NO: 1126 - protein, 450 aa, Artificial Sequence; identical to SEQ ID NO: 318
  Description of Artificial Sequence: Synthetic polypeptide
  XENC1140 Chain 1 -  1F4B5[FAP]_H1_IgG1_C220S/S364K/E357Q

SEQ ID NO: 1127 - protein, 620 aa, Artificial Sequence
  Description of Artificial Sequence: Synthetic polypeptide
  XENC1140 Chain 2 -  1F4B5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1128 - protein, 214 aa, Artificial Sequence; identical to SEQ ID NO: 260
  Description of Artificial Sequence: Synthetic polypeptide
  XENC1140 Chain 3 -  1F4B5[FAP]_L1

SEQ ID NO: 1129 - protein, 450 aa, Artificial Sequence; identical to SEQ ID NO: 318
  Description of Artificial Sequence: Synthetic polypeptide
  XENC1141 Chain 1 -  1F4B5[FAP]_H1_IgG1_C220S/S364K/E357Q

SEQ ID NO: 1130 - protein, 620 aa, Artificial Sequence
  Description of Artificial Sequence: Synthetic polypeptide
  XENC1141 Chain 2 -  1F4B5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1131 - protein, 214 aa, Artificial Sequence; identical to SEQ ID NO: 260
  Description of Artificial Sequence: Synthetic polypeptide
  XENC1141 Chain 3 -  1F4B5[FAP]_L1

SEQ ID NO: 1132 - protein, 450 aa, Artificial Sequence; identical to SEQ ID NO: 318
  Description of Artificial Sequence: Synthetic polypeptide
  XENC1142 Chain 1 -  1F4B5[FAP]_H1_IgG1_C220S/S364K/E357Q

SEQ ID NO: 1133 - protein, 620 aa, Artificial Sequence
  Description of Artificial Sequence: Synthetic polypeptide
  XENC1142 Chain 2 -  1F4B5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1134 - protein, 214 aa, Artificial Sequence; identical to SEQ ID NO: 260
  Description of Artificial Sequence: Synthetic polypeptide
  XENC1142 Chain 3 -  1F4B5[FAP]_L1

SEQ ID NO: 1135 - protein, 450 aa, Artificial Sequence; identical to SEQ ID NO: 318
  Description of Artificial Sequence: Synthetic polypeptide
  XENC1143 Chain 1 -  1F4B5[FAP]_H1_IgG1_C220S/S364K/E357Q

SEQ ID NO: 1136 - protein, 620 aa, Artificial Sequence
  Description of Artificial Sequence: Synthetic polypeptide
  XENC1143 Chain 2 -  1F4B5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1137 - protein, 214 aa, Artificial Sequence; identical to SEQ ID NO: 260
  Description of Artificial Sequence: Synthetic polypeptide
  XENC1143 Chain 3 -  1F4B5[FAP]_L1

SEQ ID NO: 1138 - protein, 450 aa, Artificial Sequence; identical to SEQ ID NO: 658
  Description of Artificial Sequence: Synthetic polypeptide
  XENC1144 Chain 1 -  1F4B5[FAP]_H1_IgG1 _C220S/S364K/E357Q/M428L/N434S

SEQ ID NO: 1139 - protein, 620 aa, Artificial Sequence
  Description of Artificial Sequence: Synthetic polypeptide
  XENC1144 Chain 2 -  1F4B5[FAP]_H1_(G4S)2_[alphaCD3]_H1.30 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1140 - protein, 214 aa, Artificial Sequence; identical to SEQ ID NO: 260
  Description of Artificial Sequence: Synthetic polypeptide
  XENC1144 Chain 3 -  1F4B5[FAP]_L1

SEQ ID NO: 1141 - protein, 450 aa, Artificial Sequence; identical to SEQ ID NO: 658
  Description of Artificial Sequence: Synthetic polypeptide
  XENC1145 Chain 1 -  1F4B5[FAP]_H1_IgG1 _C220S/S364K/E357Q/M428L/N434S

SEQ ID NO: 1142 - protein, 620 aa, Artificial Sequence
  Description of Artificial Sequence: Synthetic polypeptide
  XENC1145 Chain 2 -  1F4B5[FAP]_H1_(G4S)2_[alphaCD3]_H1.32 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1143 - protein, 214 aa, Artificial Sequence; identical to SEQ ID NO: 260
  Description of Artificial Sequence: Synthetic polypeptide
  XENC1145 Chain 3 -  1F4B5[FAP]_L1

SEQ ID NO: 1144 - protein, 450 aa, Artificial Sequence; identical to SEQ ID NO: 658
  Description of Artificial Sequence: Synthetic polypeptide
  XENC1146 Chain 1 -  1F4B5[FAP]_H1_IgG1 _C220S/S364K/E357Q/M428L/N434S

SEQ ID NO: 1145 - protein, 620 aa, Artificial Sequence
  Description of Artificial Sequence: Synthetic polypeptide
  XENC1146 Chain 2 -  1F4B5[FAP]_H1_(G4S)2_[alphaCD3]_H1.89 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1146 - protein, 214 aa, Artificial Sequence; identical to SEQ ID NO: 260
  Description of Artificial Sequence: Synthetic polypeptide
  XENC1146 Chain 3 -  1F4B5[FAP]_L1

SEQ ID NO: 1147 - protein, 450 aa, Artificial Sequence; identical to SEQ ID NO: 658
  Description of Artificial Sequence: Synthetic polypeptide
  XENC1147 Chain 1 -  1F4B5[FAP]_H1_IgG1 _C220S/S364K/E357Q/M428L/N434S

SEQ ID NO: 1148 - protein, 620 aa, Artificial Sequence
  Description of Artificial Sequence: Synthetic polypeptide
  XENC1147 Chain 2 -  1F4B5[FAP]_H1_(G4S)2_[alphaCD3]_H1.90 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1149 - protein, 214 aa, Artificial Sequence; identical to SEQ ID NO: 260
  Description of Artificial Sequence: Synthetic polypeptide
  XENC1147 Chain 3 -  1F4B5[FAP]_L1

SEQ ID NO: 1150 - protein, 450 aa, Artificial Sequence; identical to SEQ ID NO: 658
  Description of Artificial Sequence: Synthetic polypeptide
  XENC1148 Chain 1 -  1F4B5[FAP]_H1_IgG1 _C220S/S364K/E357Q/M428L/N434S

SEQ ID NO: 1151 - protein, 620 aa, Artificial Sequence
  Description of Artificial Sequence: Synthetic polypeptide
  XENC1148 Chain 2 -  1F4B5[FAP]_H1_(G4S)2_[alphaCD3]_H1.33 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1152 - protein, 214 aa, Artificial Sequence; identical to SEQ ID NO: 260
  Description of Artificial Sequence: Synthetic polypeptide
  XENC1148 Chain 3 -  1F4B5[FAP]_L1

SEQ ID NO: 1153 - protein, 450 aa, Artificial Sequence; identical to SEQ ID NO: 658
  Description of Artificial Sequence: Synthetic polypeptide
  XENC1149 Chain 1 -  1F4B5[FAP]_H1_IgG1 _C220S/S364K/E357Q/M428L/N434S

SEQ ID NO: 1154 - protein, 620 aa, Artificial Sequence
  Description of Artificial Sequence: Synthetic polypeptide
  XENC1149 Chain 2 -  1F4B5[FAP]_H1_(G4S)2_[alphaCD3]_H1.31 _L1.47_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1155 - protein, 214 aa, Artificial Sequence; identical to SEQ ID NO: 260
  Description of Artificial Sequence: Synthetic polypeptide
  XENC1149 Chain 3 -  1F4B5[FAP]_L1

SEQ ID NO: 1156 - protein, 450 aa, Artificial Sequence; identical to SEQ ID NO: 658
  Description of Artificial Sequence: Synthetic polypeptide
  XENC1150 Chain 1 -  1F4B5[FAP]_H1_IgG1 _C220S/S364K/E357Q/M428L/N434S

SEQ ID NO: 1157 - protein, 620 aa, Artificial Sequence
  Description of Artificial Sequence: Synthetic polypeptide
  XENC1150 Chain 2 -  1F4B5[FAP]_H1_(G4S)2_[alphaCD3] _L1.47 _H1.30_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1158 - protein, 214 aa, Artificial Sequence; identical to SEQ ID NO: 260
  Description of Artificial Sequence: Synthetic polypeptide
  XENC1150 Chain 3 -  1F4B5[FAP]_L1

SEQ ID NO: 1159 - protein, 450 aa, Artificial Sequence; identical to SEQ ID NO: 658
  Description of Artificial Sequence: Synthetic polypeptide
  XENC1151 Chain 1 -  1F4B5[FAP]_H1_IgG1 _C220S/S364K/E357Q/M428L/N434S

SEQ ID NO: 1160 - protein, 620 aa, Artificial Sequence
  Description of Artificial Sequence: Synthetic polypeptide
  XENC1151 Chain 2 -  1F4B5[FAP]_H1_(G4S)2_[alphaCD3] _L1.47 _H1.32_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1161 - protein, 214 aa, Artificial Sequence; identical to SEQ ID NO: 260
  Description of Artificial Sequence: Synthetic polypeptide
  XENC1151 Chain 3 -  1F4B5[FAP]_L1

SEQ ID NO: 1162 - protein, 450 aa, Artificial Sequence; identical to SEQ ID NO: 658
  Description of Artificial Sequence: Synthetic polypeptide
  XENC1152 Chain 1 -  1F4B5[FAP]_H1_IgG1 _C220S/S364K/E357Q/M428L/N434S

SEQ ID NO: 1163 - protein, 620 aa, Artificial Sequence
  Description of Artificial Sequence: Synthetic polypeptide
  XENC1152 Chain 2 -  1F4B5[FAP]_H1_(G4S)2_[alphaCD3] _L1.47 _H1.89_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1164 - protein, 214 aa, Artificial Sequence; identical to SEQ ID NO: 260
  Description of Artificial Sequence: Synthetic polypeptide
  XENC1152 Chain 3 -  1F4B5[FAP]_L1

SEQ ID NO: 1165 - protein, 450 aa, Artificial Sequence; identical to SEQ ID NO: 658
  Description of Artificial Sequence: Synthetic polypeptide
  XENC1153 Chain 1 -  1F4B5[FAP]_H1_IgG1 _C220S/S364K/E357Q/M428L/N434S

SEQ ID NO: 1166 - protein, 620 aa, Artificial Sequence
  Description of Artificial Sequence: Synthetic polypeptide
  XENC1153 Chain 2 -  1F4B5[FAP]_H1_(G4S)2_[alphaCD3] _L1.47 _H1.90_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1167 - protein, 214 aa, Artificial Sequence; identical to SEQ ID NO: 260
  Description of Artificial Sequence: Synthetic polypeptide
  XENC1153 Chain 3 -  1F4B5[FAP]_L1

SEQ ID NO: 1168 - protein, 450 aa, Artificial Sequence; identical to SEQ ID NO: 658
  Description of Artificial Sequence: Synthetic polypeptide
  XENC1154 Chain 1 -  1F4B5[FAP]_H1_IgG1 _C220S/S364K/E357Q/M428L/N434S

SEQ ID NO: 1169 - protein, 620 aa, Artificial Sequence
  Description of Artificial Sequence: Synthetic polypeptide
  XENC1154 Chain 2 -  1F4B5[FAP]_H1_(G4S)2_[alphaCD3] _L1.47 _H1.33_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1170 - protein, 214 aa, Artificial Sequence; identical to SEQ ID NO: 260
  Description of Artificial Sequence: Synthetic polypeptide
  XENC1154 Chain 3 -  1F4B5[FAP]_L1

SEQ ID NO: 1171 - protein, 450 aa, Artificial Sequence; identical to SEQ ID NO: 658
  Description of Artificial Sequence: Synthetic polypeptide
  XENC1155 Chain 1 -  1F4B5[FAP]_H1_IgG1 _C220S/S364K/E357Q/M428L/N434S

SEQ ID NO: 1172 - protein, 620 aa, Artificial Sequence
  Description of Artificial Sequence: Synthetic polypeptide
  XENC1155 Chain 2 -  1F4B5[FAP]_H1_(G4S)2_[alphaCD3] _L1.47 _H1.31_scFv(GKPGS)4_(G4S)2_IgG1_PVA_/S267K-pI(-)_Isosteric_A _L368D/K370S/M428L/N434S
EVQLLESGGGLVQPGGSLRLSCAASGFTFSRYAMTWVRQAPGKGLEWVSSISASGGSTYYADSVKGRFTISRDNSKNTLYLQMNSLRAEDTAVYYCAKTFSGYAHYDFDYWGQGTLVTVSSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1173 - protein, 214 aa, Artificial Sequence; identical to SEQ ID NO: 260
  Description of Artificial Sequence: Synthetic polypeptide
  XENC1155 Chain 3 -  1F4B5[FAP]_L1

SEQ ID NO: 1174 - protein, 10 aa, Artificial Sequence
  Description of Artificial Sequence: Synthetic peptide
GGGGSGGGGS

SEQ ID NO: 1175 - protein, 6 aa, Artificial Sequence
  Description of Artificial Sequence: Synthetic 6xHis tag
HHHHHH

SEQ ID NO: 1176 - protein, 5 aa, Artificial Sequence
  Description of Artificial Sequence: Synthetic peptide
  See specification as filed for detailed description of substitutions and preferred embodiments
GSGGS

SEQ ID NO: 1177 - protein, 5 aa, Artificial Sequence
  Description of Artificial Sequence: Synthetic peptide
  See specification as filed for detailed description of substitutions and preferred embodiments
GGGGS

SEQ ID NO: 1178 - protein, 4 aa, Artificial Sequence
  Description of Artificial Sequence: Synthetic peptide
  See specification as filed for detailed description of substitutions and preferred embodiments
GGGS

SEQ ID NO: 1179 - protein, 6 aa, Artificial Sequence
  Description of Artificial Sequence: Synthetic peptide
GGSGGS

What is claimed is:

1. A composition comprising a fibroblast activation protein (FAP) binding domain, the FAP binding domain comprising:
   a) a variable heavy domain comprising a vhCDR1, vhCDR2, and vhCDR3; and
   b) a variable light domain comprising a vlCDR1, vlCDR2, and vlCDR3;
   wherein vhCDR1-3 and vlCDR1-3 are selected from the following:
      i) a vhCDR1 having SEQ ID NO: 246, a vhCDR2 having SEQ ID NO: 247, a vhCDR3 having SEQ ID NO: 248, a vlCDR1 having SEQ ID NO: 250, a vlCDR2 having SEQ ID NO: 251, and a vlCDR3 having SEQ ID NO: 252;
      ii) a vhCDR1 having SEQ ID NO: 230, a vhCDR2 having SEQ ID NO: 231, a vhCDR3 having SEQ ID NO: 232, a vlCDR1 having SEQ ID NO: 234, a vlCDR2 having SEQ ID NO: 235, and a vlCDR3 having SEQ ID NO: 236; and
      iii) a vhCDR1 having SEQ ID NO: 238, a vhCDR2 having SEQ ID NO: 239, a vhCDR3 having SEQ ID NO: 240, a vlCDR1 having SEQ ID NO: 242, a vlCDR2 having SEQ ID NO: 243, and a vlCDR3 having SEQ ID NO: 244.

2. The composition of claim 1, wherein the variable heavy domain has SEQ ID NO: 245 and the variable light domain has SEQ ID NO: 249.

3. The composition of claim 1, wherein the variable heavy domain has SEQ ID NO: 229 and the variable light domain has SEQ ID NO: 233.

4. The composition of claim 1, wherein the variable heavy domain has SEQ ID NO: 237 and the variable light domain has SEQ ID NO: 241.

5. A nucleic acid composition comprising:
   a) a first nucleic acid encoding a variable heavy domain; and
   b) a second nucleic acid encoding a variable light domain,
   wherein the variable heavy domain and variable light domain are as set forth in any one of claims 2-4.

6. An expression vector composition comprising:
   a) a first expression vector comprising a nucleic acid encoding a variable heavy domain; and
   b) a second expression vector comprising a nucleic acid encoding a variable light domain,
   wherein the variable heavy domain and variable light domain are as set forth in any one of claims 2-4.

7. A nucleic acid composition comprising:
   a) a first nucleic acid encoding a variable heavy domain; and
   b) a second nucleic acid encoding a variable light domain,
   wherein the variable heavy domain vhCDR1-3 and the variable light domain v1CDR1-3 are selected from part b)i), part b)ii), or part b)iii) of claim 1.

8. An expression vector composition comprising:
   a) a first expression vector comprising a first nucleic acid encoding a variable heavy domain; and
   b) a second expression vector comprising second nucleic acid encoding a variable light domain,
   wherein the variable heavy domain vhCDR1-3 and the variable light domain v1CDR1-3 are selected from part b)i), part b)ii), or part b)iii).

9. A host cell comprising the expression vector composition of claim 8.

10. A method of making a FAP binding domain comprising:
    culturing the host cell of claim 9 under conditions wherein the first variable heavy domain and first variable light domain are expressed and the FAP binding domain is formed; and
    purifying the FAP binding domain.

11. A heterodimeric antibody comprising:
    a) a first monomer comprising, from N- to C-terminus, a VH1-CH1-linker 1-scFv-linker 2-CH2-CH3, wherein CH2-CH3 is a first Fc domain, and wherein linker 1 and linker 2 are a first linker and a second linker, respectively;
    b) a second monomer comprising, from N- to C-terminus, a VH1-CH1-hinge-CH2-CH3, wherein CH2-CH3 is a second Fc domain; and
    c) a common light chain comprising, from N- to C-terminus, a VL1-CL,
    wherein VH1 is a first variable heavy domain and VL1 is a first variable light domain and VH1 and VL1 form two FAP binding domains;
    wherein the first variable heavy domain and first variable light domain are selected from the following:
       i) a first variable heavy domain having SEQ ID NO: 245 and a first variable light domain having SEQ ID NO: 249;
       ii) a first variable heavy domain having SEQ ID NO: 229 and a first variable light domain having SEQ ID NO: 233; and
       iii) a first variable heavy domain having SEQ ID NO: 237 and a first variable light domain having SEQ ID NO: 241,
       wherein the scFv is an anti-CD3 scFv comprising a second variable heavy domain (VH2) covalently attached to a second variable light domain (VL2) by an scFv linker.

12. The heterodimeric antibody of claim 11, wherein the scFv is in the orientation, from N- to C-terminus, VH2-scFv linker-VL2.

13. The heterodimeric antibody of claim 11, wherein the scFv is in the orientation, from N- to C-terminus, VL2-scFv linker-VH2.

14. The heterodimeric antibody of claim 11, wherein the second variable heavy domain and second variable light domain are selected from the following:
  a) a second variable heavy domain having SEQ ID NO: 73 and a second variable light domain having SEQ ID NO: 79;
  b) a second variable heavy domain having SEQ ID NO: 85 and a second variable light domain having SEQ ID NO: 89;
  c) a second variable heavy domain having SEQ ID NO: 95 and a second variable light domain having SEQ ID NO: 99;
  d) a second variable heavy domain having SEQ ID NO: 105 and a second variable light domain having SEQ ID NO: 109;
  e) a second variable heavy domain having SEQ ID NO: 115 and a second variable light domain having SEQ ID NO: 119; and
  f) a second variable heavy domain having SEQ ID NO: 125 and a second variable light domain having SEQ ID NO: 129.

15. The heterodimeric antibody of claim 11, wherein the first Fc domain is a first variant human IgG Fc domain and the second Fc domain is a second variant human IgG Fc domain.

16. The heterodimeric antibody of claim 15, wherein the first variant human IgG Fc domain comprises amino acid substitutions S364K/E357Q and the second variant human IgG Fc domain comprises amino acid substitutions L368D/K370S, wherein numbering is according to EU numbering.

17. The heterodimeric antibody of claim 15, wherein the first variant human IgG Fc domain and the second variant human IgG Fc domain each comprise amino acid substitutions E233P/L234V/L235A/G236del/S267K, wherein numbering is according to EU numbering.

18. The heterodimeric antibody of claim 15, wherein the first variant human IgG Fc domain comprises amino acid substitutions S364K/E357Q and the second variant human IgG Fc domain comprises amino acid substitutions L368D/K370S,
  wherein the first variant human IgG Fc domain and the second variant human IgG Fc domain each further comprise amino acid substitutions E233P/L234V/L235A/G236del/S267K,
  wherein the CH1-hinge-CH2-CH3 of the second monomer comprises amino acid substitutions N208D/Q295E/N384D/Q418E/N421D, wherein numbering is according to EU numbering.

19. The heterodimeric antibody of claim 18, wherein the first variant human IgG Fc domain and the second variant human IgG Fc domain each further comprise amino acid substitutions M428L/N434S, wherein numbering is according to EU numbering.

20. A nucleic acid composition comprising:
  a) a first nucleic acid encoding a first monomer;
  b) a second nucleic acid encoding a second monomer; and
  c) a third nucleic acid encoding a common light chain,
  wherein the first monomer comprises, from N- to C-terminus, a VH1-CH1-linker 1-scFv-linker 2-CH2-CH3, wherein CH2-CH3 is a first Fc domain, and wherein linker 1 and linker 2 are a first linker and a second linker, respectively,
  wherein the second monomer comprises, from N- to C-terminus, a VH1-CH1-hinge-CH2-CH3, wherein CH2-CH3 is a second Fc domain,
  wherein the common light chain comprises, from N- to C-terminus, a VL1-CL,
  wherein VH1 is a first variable heavy domain and VL1 is a first variable light domain and VH1 and VL1 form two FAP binding domains;
  wherein the first variable heavy domain and first variable light domain are selected from the following:
    i) a first variable heavy domain having SEQ ID NO: 245 and a first variable light domain having SEQ ID NO: 249;
    ii) a first variable heavy domain having SEQ ID NO: 229 and a first variable light domain having SEQ ID NO: 233; and
    iii) a first variable heavy domain having SEQ ID NO: 237 and a first variable light domain having SEQ ID NO: 241, and
  wherein the scFv is an anti-CD3 scFv comprising a second variable heavy domain (VH2) covalently attached to a second variable light domain (VL2) by an scFv linker.

21. An expression vector composition comprising:
  a) a first expression vector comprising a first nucleic acid encoding a first monomer;
  b) a second expression vector comprising a second nucleic acid encoding a second monomer; and
  c) a third expression vector comprising a third nucleic acid encoding a common light chain,
  wherein the first monomer comprises, from N- to C-terminus, a VH1-CH1-linker 1-scFv-linker 2-CH2-CH3, wherein CH2-CH3 is a first Fc domain, and wherein linker 1 and linker 2 are a first linker and a second linker, respectively,
  wherein the second monomer comprises, from N- to C-terminus, a VH1-CH1-hinge-CH2-CH3, wherein CH2-CH3 is a second Fc domain,
  wherein the common light chain comprises, from N- to C-terminus, a VL1-CL,
  wherein VH1 is a first variable heavy domain and VL1 is a first variable light domain and VH1 and VL1 form two FAP binding domains;
  wherein the first variable heavy domain and first variable light domain are selected from the following:
    i) a first variable heavy domain having SEQ ID NO: 245 and a first variable light domain having SEQ ID NO: 249;
    ii) a first variable heavy domain having SEQ ID NO: 229 and a first variable light domain having SEQ ID NO: 233; and
    iii) a first variable heavy domain having SEQ ID NO: 237 and a first variable light domain having SEQ ID NO: 241, and
  wherein the scFv is an anti-CD3 scFv comprising a second variable heavy domain (VH2) covalently attached to a second variable light domain (VL2) by an scFv linker.

22. A host cell comprising the expression vector composition of claim 21.

23. A method of making a heterodimeric antibody comprising:
  a) culturing the host cell of claim 22 under conditions wherein the first monomer, the second monomer and the common light chain are expressed and the heterodimeric antibody is formed; and
  b) purifying the heterodimeric antibody.

* * * * *